(12) United States Patent
Henley et al.

(10) Patent No.: US 12,104,179 B2
(45) Date of Patent: Oct. 1, 2024

(54) GENETICALLY MODIFIED ORGANISMS FOR PRODUCING PSYCHOTROPIC ALKALOIDS

(71) Applicant: EMPYREAN NEUROSCIENCE, INC., New York, NY (US)

(72) Inventors: Thomas Henley, Soham (GB); Modassir Choudhry, New York, NY (US); Jose Fernandez-Gomez, Bar Hill (GB); Antoine Larrieu, Soham (GB); Beata Orman-Ligeza, Longstanton (GB); Umar Mohammed, Cambridge (GB); Emma McKechnie-Welsh, Cambridge (GB)

(73) Assignee: Empyrean Neuroscience, Inc., New York, NY (US)

( * ) Notice: Subject to any disclaimer, the term of this patent is extended or adjusted under 35 U.S.C. 154(b) by 0 days.

(21) Appl. No.: 18/474,786

(22) Filed: Sep. 26, 2023

(65) Prior Publication Data
US 2024/0101976 A1    Mar. 28, 2024

Related U.S. Application Data

(63) Continuation of application No. PCT/US2022/082631, filed on Dec. 30, 2022.

(60) Provisional application No. 63/295,723, filed on Dec. 31, 2021, provisional application No. 63/295,735, filed on Dec. 31, 2021, provisional application No. 63/295,739, filed on Dec. 31, 2021, provisional application No. 63/295,742, filed on Dec. 31, 2021.

(51) Int. Cl.
| | | |
|---|---|---|
| *C12N 9/10* | (2006.01) | |
| *A61K 35/66* | (2015.01) | |
| *C12N 9/22* | (2006.01) | |
| *C12N 15/11* | (2006.01) | |

(52) U.S. Cl.
CPC ............ *C12N 9/1007* (2013.01); *A61K 35/66* (2013.01); *C12N 9/22* (2013.01); *C12N 15/11* (2013.01); *C12N 2310/20* (2017.05); *C12N 2800/80* (2013.01)

(58) Field of Classification Search
CPC .................................................. C12N 9/1007
See application file for complete search history.

(56) References Cited

U.S. PATENT DOCUMENTS

| | | |
|---|---|---|
| 3,183,172 A | 5/1965 | Heim et al. |
| 9,072,747 B2 | 7/2015 | Lozinsky |
| 9,538,418 B2 | 1/2017 | Sirotkin |
| 10,064,856 B2 | 9/2018 | Bosse |
| 10,085,994 B2 | 10/2018 | Lozinsky |
| 10,085,995 B2 | 10/2018 | Lozinsky |
| 10,183,001 B1 | 1/2019 | King |
| 10,457,667 B2 | 10/2019 | Gaufreteau et al. |
| 10,519,175 B2 | 12/2019 | Londesbrough et al. |
| 10,596,378 B2 | 3/2020 | Rustick |
| 10,729,706 B2 | 8/2020 | Küçüksen et al. |
| 10,881,606 B2 | 1/2021 | Schmitz |
| 10,881,607 B2 | 1/2021 | Schmitz |
| 10,933,073 B2 | 3/2021 | Chadeayne |
| 10,947,257 B2 | 3/2021 | Londesbrough |
| 10,954,259 B1 | 3/2021 | Londesbrough |
| 11,000,534 B1 | 5/2021 | Sippy |
| 11,149,044 B2 | 10/2021 | Londesbrough |
| 11,180,517 B2 | 11/2021 | Londesbrough |
| 11,242,318 B2 | 2/2022 | Nivorozhkin |
| 11,292,765 B2 | 4/2022 | Bryson |
| 11,298,388 B2 | 4/2022 | Lightburn |
| 11,312,684 B1 | 4/2022 | Nichols |
| 11,324,762 B2 | 5/2022 | Sippy |
| 11,331,357 B2 | 5/2022 | Lightburn |
| 11,344,564 B1 | 5/2022 | Sippy |
| 11,358,934 B2 | 6/2022 | Chadeayne |
| 11,364,221 B2 | 6/2022 | Liechti |
| 2006/0127889 A1 | 6/2006 | Dotson et al. |
| 2014/0255521 A1 | 9/2014 | Lozinsky |
| 2014/0256688 A1 | 9/2014 | Lozinsky |
| 2015/0272957 A1 | 10/2015 | Lozinsky |
| 2016/0208299 A1 | 7/2016 | Ketchum |
| 2016/0331725 A1 | 11/2016 | Gillessen |
| 2017/0273975 A1 | 9/2017 | Yada et al. |
| 2018/0221396 A1 | 8/2018 | Chadeayne |
| 2019/0105313 A1 | 4/2019 | Stamets |
| 2019/0161764 A1 | 5/2019 | Winzer |

(Continued)

FOREIGN PATENT DOCUMENTS

| | | |
|---|---|---|
| AU | 2019208238 | 2/2021 |
| CA | 3046911 A1 | 12/2020 |

(Continued)

OTHER PUBLICATIONS

Befort, K., "Interactions of the opioid and cannabinoid systems in reward: Insights from knockout studies" Front Pharmacol. Feb. 5, 2015;6:6, pp. 1-15, doi: 10.3389/fphar.2015.00006.

(Continued)

*Primary Examiner* — Suzanne M Noakes
(74) *Attorney, Agent, or Firm* — Greenberg Traurig, LLP

(57) ABSTRACT

This disclosure provides genetically engineered organisms with genetic modifications that are useful for producing desirable alkaloids. This disclosure also provides methods of making genetically engineered organisms that can produce desirable alkaloids. The organisms described herein produce alkaloids in amounts beyond that produced from comparable wild-type organisms. In certain embodiments, the genetically engineered organisms are fungi from the Basidiomycota division.

15 Claims, 50 Drawing Sheets

Specification includes a Sequence Listing.

(56) References Cited

U.S. PATENT DOCUMENTS

| | | |
|---|---|---|
| 2019/0192498 A1 | 6/2019 | Stamets |
| 2019/0309357 A1 | 10/2019 | Abudayyeh et al. |
| 2019/0350949 A1 | 11/2019 | Küçüksen |
| 2020/0199161 A1 | 6/2020 | Londesbrough |
| 2020/0331939 A1 | 10/2020 | Londesbrough |
| 2020/0352206 A1 | 11/2020 | Wagner-Salvini |
| 2020/0375967 A1 | 12/2020 | Stamets |
| 2021/0010015 A1 | 1/2021 | Mojzita et al. |
| 2021/0015738 A1 | 1/2021 | Larosa |
| 2021/0015833 A1 | 1/2021 | Larosa |
| 2021/0023052 A1 | 1/2021 | Chadeayne |
| 2021/0030014 A1 | 2/2021 | Brown et al. |
| 2021/0069170 A1 | 3/2021 | Stamets |
| 2021/0085671 A1 | 3/2021 | Chadeayne |
| 2021/0087212 A1 | 3/2021 | Londesbrough |
| 2021/0095301 A1 | 4/2021 | Winzer |
| 2021/0108238 A1 | 4/2021 | Protzko |
| 2021/0113644 A1 | 4/2021 | Chadeayne |
| 2021/0137854 A1 | 5/2021 | Goren |
| 2021/0145851 A1 | 5/2021 | Stamets |
| 2021/0147888 A1 | 5/2021 | Vogan |
| 2021/0155642 A1 | 5/2021 | Londesbrough |
| 2021/0161894 A1 | 6/2021 | Le Couteur |
| 2021/0236523 A1 | 8/2021 | Schindler |
| 2021/0246133 A1 | 8/2021 | Hilpert et al. |
| 2021/0246152 A1 | 8/2021 | Londesbrough |
| 2021/0251969 A1 | 8/2021 | Abdallah |
| 2021/0251976 A1 | 8/2021 | Stamets |
| 2021/0267966 A1 | 9/2021 | Petcavich |
| 2021/0267977 A1 | 9/2021 | Liechti |
| 2021/0275618 A1 | 9/2021 | Davidson |
| 2021/0315884 A1 | 10/2021 | Liechti |
| 2021/0322447 A1 | 10/2021 | Plakogiannis |
| 2021/0346341 A1 | 11/2021 | Liechti |
| 2021/0346346 A1 | 11/2021 | Chadeayne |
| 2021/0346347 A1 | 11/2021 | Witowski |
| 2021/0353615 A1 | 11/2021 | Chadeayne |
| 2021/0361679 A1 | 11/2021 | Chadeayne |
| 2021/0392933 A1 | 12/2021 | Lilly |
| 2021/0393716 A1 | 12/2021 | Lightburn |
| 2021/0403425 A1 | 12/2021 | Bryson |
| 2021/0407643 A1 | 12/2021 | Liu |
| 2022/0016104 A1 | 1/2022 | Stamets |
| 2022/0040246 A1 | 2/2022 | Lightburn |
| 2022/0054402 A1 | 2/2022 | Kaufman |
| 2022/0062310 A1 | 3/2022 | Kelmendi |
| 2022/0071946 A1 | 3/2022 | Land |
| 2022/0073548 A1 | 3/2022 | Londesbrough |
| 2022/0079881 A1 | 3/2022 | Modi |
| 2022/0088041 A1 | 3/2022 | Londesbrough |
| 2022/0096429 A1 | 3/2022 | Liechti |
| 2022/0096504 A1 | 3/2022 | Blumstock |
| 2022/0110955 A1 | 4/2022 | Sippy |
| 2022/0119346 A1 | 4/2022 | Nivorozhkin |
| 2022/0125091 A1 | 4/2022 | Cave |
| 2022/0125755 A1 | 4/2022 | Hazen |
| 2022/0125809 A1 | 4/2022 | Stamets |
| 2022/0125810 A1 | 4/2022 | Cave |
| 2022/0127058 A1 | 4/2022 | Roth |
| 2022/0143051 A1 | 5/2022 | Manfredi |
| 2022/0151993 A1 | 5/2022 | Ross |
| 2022/0160737 A1 | 5/2022 | Stamets |
| 2022/0169668 A1 | 6/2022 | Londesbrough |
| 2022/0202775 A1 | 6/2022 | Rands |
| 2022/0211660 A1 | 7/2022 | Cave |
| 2022/0211671 A1 | 7/2022 | Moss |
| 2022/0226405 A1 | 7/2022 | Lightburn |

FOREIGN PATENT DOCUMENTS

| | | |
|---|---|---|
| CA | 2888449 C | 1/2021 |
| CA | 3050553 A1 | 1/2021 |
| EP | 3371168 | 5/2020 |
| EP | 3371174 | 3/2021 |
| IN | 201647012284 | 7/2016 |
| IN | 201811011332 | 10/2019 |
| IN | 201821011763 | 10/2019 |
| IN | 201811018597 | 11/2019 |
| IN | 20184102214 | 9/2020 |
| IN | 202014041837 | 10/2020 |
| IN | 201941029795 | 1/2021 |
| IN | 202121000935 | 1/2021 |
| IN | 202141031070 | 7/2021 |
| IN | 202041012021 | 9/2021 |
| IN | 202141043033 | 11/2021 |
| IN | 202121049931 | 12/2021 |
| WO | 2009/073633 | 6/2009 |
| WO | 2010139703 | 12/2010 |
| WO | 2011/020206 | 2/2011 |
| WO | 2013/022881 | 2/2013 |
| WO | 2014/008138 | 1/2014 |
| WO | 2014/110540 | 7/2014 |
| WO | 2014/195208 | 12/2014 |
| WO | 2015/077292 | 5/2015 |
| WO | 2015/136947 | 9/2015 |
| WO | 2015/197567 | 12/2015 |
| WO | 2017/076852 | 5/2017 |
| WO | 2018/112459 | 6/2018 |
| WO | 2019/090158 | 5/2019 |
| WO | 2019/162949 | 8/2019 |
| WO | 2019/173797 | 9/2019 |
| WO | 2019/180309 | 9/2019 |
| WO | 2019/224300 | 11/2019 |
| WO | 2020/033955 | 2/2020 |
| WO | 2020/172492 | 8/2020 |
| WO | 2020/223728 | 11/2020 |
| WO | 2020255151 | 12/2020 |
| WO | 2021/052989 | 3/2021 |
| WO | 2021067626 | 4/2021 |
| WO | 2021067626 A2 | 4/2021 |
| WO | 2021/097452 | 5/2021 |
| WO | 2021086513 A1 | 5/2021 |
| WO | 2021110992 | 6/2021 |
| WO | 2021138564 A1 | 7/2021 |
| WO | 2021158888 A1 | 8/2021 |
| WO | 2021173273 A1 | 9/2021 |
| WO | 2021173989 A1 | 9/2021 |
| WO | 2021178579 A1 | 9/2021 |
| WO | 2021188782 A1 | 9/2021 |
| WO | 2021188812 A1 | 9/2021 |
| WO | 2021188870 A1 | 9/2021 |
| WO | 2021/205196 | 10/2021 |
| WO | 2021202730 A1 | 10/2021 |
| WO | 2021207137 A1 | 10/2021 |
| WO | 2021207824 A1 | 10/2021 |
| WO | 2021209815 A1 | 10/2021 |
| WO | 2021211358 A1 | 10/2021 |
| WO | 2021216489 A1 | 10/2021 |
| WO | 2021/237162 | 11/2021 |
| WO | 2021222885 A1 | 11/2021 |
| WO | 2021225796 A1 | 11/2021 |
| WO | 2021226041 A1 | 11/2021 |
| WO | 2021226416 A1 | 11/2021 |
| WO | 2021236759 A2 | 11/2021 |
| WO | 2021/248087 | 12/2021 |
| WO | 2021243460 A1 | 12/2021 |
| WO | 2021250434 A1 | 12/2021 |
| WO | 2021250435 A1 | 12/2021 |
| WO | 2021252692 A1 | 12/2021 |
| WO | 2021253116 A1 | 12/2021 |
| WO | 2021253123 A1 | 12/2021 |
| WO | 2021253124 A1 | 12/2021 |
| WO | 2021262871 A1 | 12/2021 |
| WO | 2022000091 | 1/2022 |
| WO | 2022011350 | 1/2022 |
| WO | 2022018709 A1 | 1/2022 |
| WO | 2022023812 | 2/2022 |
| WO | 2022031551 A1 | 2/2022 |
| WO | 2022031552 A1 | 2/2022 |
| WO | 2022031907 A1 | 2/2022 |
| WO | 2022038299 A1 | 2/2022 |
| WO | 2022040802 A1 | 3/2022 |
| WO | 2022047579 A1 | 3/2022 |
| WO | 2022047580 A1 | 3/2022 |

(56) References Cited

FOREIGN PATENT DOCUMENTS

| | | |
|---|---|---|
| WO | 2022047583 A1 | 3/2022 |
| WO | 2022051578 A1 | 3/2022 |
| WO | 2022061196 A1 | 3/2022 |
| WO | 2022069690 | 4/2022 |
| WO | 2022072808 A1 | 4/2022 |
| WO | 2022076642 A1 | 4/2022 |
| WO | 2022079574 | 4/2022 |
| WO | 2022081549 A1 | 4/2022 |
| WO | 2022082058 A1 | 4/2022 |
| WO | 2022084480 A1 | 4/2022 |
| WO | 2022091051 A1 | 5/2022 |
| WO | 2022091061 A1 | 5/2022 |
| WO | 2022094054 A1 | 5/2022 |
| WO | 2022094719 A1 | 5/2022 |
| WO | 2022104475 A1 | 5/2022 |
| WO | 2022115798 A2 | 6/2022 |
| WO | 2022115944 A1 | 6/2022 |
| WO | 2022115960 A1 | 6/2022 |
| WO | 2022117359 A1 | 6/2022 |
| WO | 2022120181 A1 | 6/2022 |
| WO | 2022120289 | 6/2022 |
| WO | 2022123232 A1 | 6/2022 |
| WO | 2022125616 A1 | 6/2022 |
| WO | 2022125949 A1 | 6/2022 |
| WO | 2022132691 A1 | 6/2022 |
| WO | 2022140841 A1 | 7/2022 |
| WO | 2022140842 A1 | 7/2022 |
| WO | 2022140846 A1 | 7/2022 |
| WO | 2022140851 A1 | 7/2022 |
| WO | 2022150530 A1 | 7/2022 |
| WO | 2022150563 A1 | 7/2022 |
| WO | 2022150675 A1 | 7/2022 |
| WO | 2022150840 A1 | 7/2022 |
| WO | 2022150854 A1 | 7/2022 |
| WO | 2022155352 A1 | 7/2022 |
| WO | 2022155591 A1 | 7/2022 |
| WO | 2022155751 A1 | 7/2022 |

OTHER PUBLICATIONS

Compass Pathways, "Responding to an urgent mental health crisis, Challenges and solutions for people suffering with treatment-resistant depression" A White Paper from COMPASS Pathways, Aug. 2021, 50 pages.

Eisenstein, M., "Base edit your way to better crops", Nature. Apr. 28, 2022;604(7907):790-792. doi: 10.1038/d41586-022-01117-z.

Fricke J, Blei F, Hoffmeister D., "Enzymatic Synthesis of Psilocybin" Angew Chem Int Ed Engl. Sep. 25, 2017;56(40):12352-12355. doi: 10.1002/anie.201705489.

Fricke, J., et al., "Production Options for Psilocybin: Making of the Magic", Chem. Eur. J., Jan. 18, 2019, 25(4):897-903, doi: 10.1002/chem.201802758.

GenBank entry KY984101 "Psilocybe cubensis strain FSU 12409 tryptophan decarboxylase (psiD) mRNA, complete cds" Aug. 26, 2017.

Gotvaldová, Klára, et al., "Stability of psilocybin and its four analogs in the biomass of the psychotropic mushroom Psilocybe cubensis" Drug Testing and Analysis, Feb. 2021, 13(2):439-446, doi:10.1002/dta.2950.

Halford, B., "Rediscovering Psychedelics", Chemical & Engineering News, Mar. 7, 2022, vol. 100; Issue 9; pp. 28-33.

ISR and written opinion for PCT/US2020/053842 mailed Mar. 26, 2021.

Lenz, C. et al., "Injury-Triggered Blueing Reactions of Psilocybe "Magic" Mushrooms." Angewandte Chemie (International Ed. in English) 59 (Nov. 14, 2019): 1450-1454.

Lenz, C., et al., Supporting Information for "Injury-Triggered Blueing Reactions of Psilocybe "Magic" Mushrooms." Angewandte Chemie (International Ed. in English) 59 (Nov. 14, 2019): 1450-1454, 36 pages.

Lin, H.-C., et al., "Biosynthesis of bioactive natural products from Basidiomycota" Organic & Biomolecular Chemistry, vol. 17, Issue 5, 2019, pp. 1027-1036, ISSN 1477-0520, doi: 10.1039/c8ob02774a.

Mahmood, Z., et al., "Bioactive alkaloids produced by fungi I. Updates on alkaloids from the species of the genera Boletus, Fusarium and Psilocybe", Jul. 2010, Pakistan Journal of Pharmaceutical Sciences 23(3):349-57.

Meyer, V., et al., "Growing a circular economy with fungal biotechnology: a white paper" Fungal Biol Biotechnol 7, 5 (2020). https://doi.org/10.1186/s40694-020-00095-z.

Milne, N., et al., "Metabolic engineering of *Saccharomyces cerevisiae* for the de novo production of psilocybin and related tryptamine derivatives", Metabolic Engineering, vol. 60, Jul. 2020, pp. 25-36, ISSN 1096-7176, doi: 10.1016/j.ymben.2019.12.007: 10.1016/j.ymben.2019.12.007.

Reynolds, H. T., et al., "Horizontal gene cluster transfer increased hallucinogenic mushroom diversity" Evol Lett. Feb. 27, 2018;2(2):88-101. doi: 10.1002/evl3.42.

Ritter, S. K., "Magic mushroom enzyme mystery solved", Chemical & Engineering News, Aug. 14, 2017, 6 pages, https://cen.acs.org/articles/95/web/2017/08/Magic-mushroomenzyme-mystery-solved.html#.

Sorrentino, G., "Introduction to emerging industrial applications of cannabis (*Cannabis sativa* L.)" Rend Lincei Sci Fis Nat. 2021;32(2):233-243. doi: 10.1007/s12210-021-00979-1. Epub Mar. 19, 2021.

Stamets, P. & Zwickey, H., "Medicinal Mushrooms: Ancient Remedies Meet Modern Science" Integrative Medicine: A Clinician's Journal, Feb. 2014;13(1):46-47.

Sugano, S.S., et al., "Genome editing in the mushroom-forming basidiomycete *Coprinopsis cinerea*, optimized by a high-throughput transformation system", Scientific Reports, Apr. 28, 2017, vol. 7, No. 1, article 1260, 9 pages.

International Search Report issued Jul. 18, 2023 in PCT/US22/82631 (7 pages).

Search Report and Written Opinion for PCT/US22/82635 mailed Sep. 29, 2023.

FIG. 16A

| Sample ID | Peak Areas (Enzymatically produced) | | |
|---|---|---|---|
| | Psilocin [RT 5.8 min.] | Quinoid [RT 5.4 min.] | Quinoid Dimers [RT 6.2, 7.2 min.] |
| 1771 (B1) | 7133071694 | 11540967 | 3599073 |
| 1772 (B2) | 7367659168 | 11327151 | 3319458 |
| 1773 (B3) | 4080318650 | 12100228 | 3580339 |

FIG. 16B

| Sample ID | Peak Areas (ESI produced) | | |
|---|---|---|---|
| | Psilocin [RT 5.8 min.] | Quinoid [RT 5.8 min.] | Quinoid Dimers [RT 5.8 min.] |
| 1771 (B1) | 7133071694 | 46091822 | 5503679 |
| 1772 (B2) | 7367659168 | 48193342 | 5248474 |
| 1773 (B3) | 4080318650 | 40867299 | 1087319 |

| Sample | Peak Area 4-hydroxytryptamine | Peak Area 4-hydroxytrimethyl-tryptamine | Peak Area Aeruginascin |
|---|---|---|---|
| 1771 (B1) | 73046304 | 23713113 | 8215736 |
| 1772 (B2) | 44269756 | 40174838 | 10001656 |
| 1773 (B3) | 2974815 | 27317436 | 7793949 |

A

B

| | | |
|---|---|---|
| PsiM_P.tampa_pr | 1 | MHIRNPYRDSINYQALAEAYPDLKPYVKVNPV-----------DDTIYTAALLQRDFGLV |
| PsiM_P.cyan ASU | 1 | MHIRNPYRDGVDYQALAEAFPALKPHVTVNSDNTTSIDFAVPEAQRLYTAALLHRDFGLT |
| PsiM_P.cub ASU6 | 1 | MHIRNPYRTPIDYQALSEAFPPLKPFVSVNADGTSSVDLTIPEAQRAFTAALLHRDFGLT |
| PsiM_P.azu_pred | 1 | MHIRNPYRTPIDYQALVEAFPPLKPYVTVNQDNTTSIDLTVPEVQRLYTAALLHRDFGLV |
| PsiM_P.tampa_pr | 50 | ISLPPDRLCPTVPN---RLNYVLWVQDILKVTSDALGLREDRPIKGIDIGTGASAIYPFL |
| PsiM_P.cyan ASU | 61 | ISLPEDRLCPTVPN---RLNYVLWVEDILKVTSDALGLPDNRQVKGIDIGTGASAIYPML |
| PsiM_P.cub ASU6 | 61 | MTIPEDRLCPTVPN---RLNYVLWIEDIFNYTNKTLGLSDDRPIKGVDIGTGASAIYPML |
| PsiM_P.azu_pred | 61 | IDLPEDRLCPTLLTRTPSLNYVLWVEDILKVTNTALGLREDRPVKGIDIGTGAAAIYPML |
| PsiM_P.tampa_pr | 107 | GCVLSKNWSMVATEVEQKCIDVARLNVVANNLQDRITILATSIDGPILVPLLEATADYEY |
| PsiM_P.cyan ASU | 118 | ACSRFKTWSMVATEVDQKCIDTARLNVIANNLQERLAIIATSVDGPILVPLLQANSDFEY |
| PsiM_P.cub ASU6 | 118 | ACARFKAWSMVGTEVERKCIDTARLNVVANNLQDRLSILETSIDGPILVPIFEATEEYEY |
| PsiM_P.azu_pred | 121 | ACARFKNWSMIGTEIDRKCIDTARVNVLTNNLQDRLSIIETSIDGPILVPIFEATTDYEY |
| PsiM_P.tampa_pr | 167 | EFTMCNPPFYDGAADMQTSDAAKGFGFGVNAPHTGSVIEMSTEGGEAAFVAQMVRESLDL |
| PsiM_P.cyan ASU | 178 | DFTMCNPPFYDGASDMQTSDAAKGFGFGVNAPHTGTVLEMATEGGESAFVAQMVRESLNL |
| PsiM_P.cub ASU6 | 178 | EFTMCNPPFYDGAADMQTSDAAKGFGFGVGAPHSGTVIEMSTEGGESAFVAQMVRESLKL |
| PsiM_P.azu_pred | 181 | DFTMCNPPFYDGAADMQTSDAAKGFGFGVNAPHSGTVIEMSTEGGESAFVAQMVRESLDH |
| PsiM_P.tampa_pr | 227 | RTRCRWFTSNLGKLASLHGIVGLLREYKITNYAINEYIQGTTRRYAIAWSFTDVRLPDEL |
| PsiM_P.cyan ASU | 238 | QTRCRWFTSNLGKLKSLYEIVGLLREHQISNYAINEYVQGATRRYAIAWSFIDVRLPDHL |
| PsiM_P.cub ASU6 | 238 | RTRCRWYTSNLGKLKSLKEIVGLLKELETSNYAINEYVQGSTRRYAVAWSFTDIQLPEEL |
| PsiM_P.azu_pred | 241 | RTRCRWFTSNLGKLKSLHEIVGLLREHQISNYAINEYVQGTTRRYAIAWSFTNIRLPEDL |
| PsiM_P.tampa_pr | 287 | FRPSNPDLAALF |
| PsiM_P.cyan ASU | 298 | SRPSNPDLSSLF |
| PsiM_P.cub ASU6 | 298 | SRPSNPELSSLF |
| PsiM_P.azu_pred | 301 | TRPSNPELSSLF |

FIG. 23

```
Tam_PsiH2   --MQNGALTVFVAFISAACIYYVHARRARRASLPPGFRGIPLPFVGNVFDMPSESSWLTFLEWGKQYQSDLIYLNSGGIE  78
Tam_PsiH    --MHTDSIVISLAAGLAVCIHFANSRRLRRASLPPGPPGIPLPFVGNMFDMPSESPWLKYLQWGKEYQSDIIYLNAGGTE  78
Cyan_PsiH2  MAPLTTMIPIVLSILIAGCIYYINARRIKRSRLPPGPPGIPIPFIGNMFDMPSESPWLTFLQWGQEYQTDIIYVDAGGTD  80
Azu_PsiH2   -------MTTIVLSILIAGCVYYTNARRIKRSSLPPGPPGIPIPFIGNMFDMPSESPWLTFLQWGQEYQTDIIYVDAGGSD  74
Cub_PsiH    -------MIAVLFSFVIAGCIYYTVSRRVVRRSRLPPGPPGIPIPFIGNMFDMPEESPWLTFLQWGRDYNTDILYVDAGGTE  74
Cyan_PsiH   MAPLTTMITILLSILLAGCIYYINARVRVRRSHLPPGPPGIPIPFIGNMFDMPSESPWLTFLQWGRDYQTDILYVDAGGSE  80
Azu_PsiH    -------MTTILLSILLAGCIYYTNARRVRRSRLPPGPPGIPIPFIGNMFDMPSESPWLTFLQWGRDYQTDILYVDAGGSE  74

Tam_PsiH2   MVILNTLETMTDLLEKRGSIYSGRLESTMVNELMGWKFDFGFVTYGERWREERRMFSREFNEKNIKQFRHAQVKALKELV  158
Tam_PsiH    IIVLNTLEAITDLLEKRGSIYSGRLESTMVNELMGWDFDLGFITYGERWREERRMFAKEFNEKNIKQFRHAQIKAANQLV  158
Cyan_PsiH2  MIILNSLEAITNLLEKRGSIYSGRLESTMVNELMGWEFDFGFITPYGERWREERRMFAKEFSEKNIRQFRHAQVKAANQLV  160
Azu_PsiH2   MIILNTLETITDLLEKRGSIYSGRLESTMVNELMGWEFDFGFITYGERWREERRMFAKEFTEKNIRQFRHAQVKAANQLV  154
Cub_PsiH    MVILNTLETITDLLEKRGSIYSGRLESTMVNELMGWEFDLGFITYGERWREERRMFAKEFSEKGIKQFRHAQVKAAHQLV  154
Cyan_PsiH   MIILNSLEAITDLLEKRGSIYSGRLESTMVNELMGWEFDLGFITYGERWREERRMFAKEFSEKNIRQFRHAQVQAANRLV  160
Azu_PsiH    MIILNSLEAITDLLEKRGSIYSGRLESTMVNELMGWEFDLGFITYGERWREERRMFAKEFSEKNIRQFRHAQVQAANRLV  154
```

FIG. 24

| | | |
|---|---|---|
| Tam_PsiH2 | RKLDKDPSRWYQHIRHQIASMAILDIGYGIDLAENDPWIEETILANDALALALASVPGCYWDSFPILQYIVPSWLPFFAGFKRK | 238 |
| Tam_PsiH | QQLAKTPQRWYQHIRHRIAAAMSLDIGYGIDLPEDDPWIEATMLANEGLAEASVPGSFWVDSFPLLKYIIPSMMPGAGFKRK | 238 |
| Cyan_PsiH2 | RQLTDKPDRWSHHIRHQIASMAILDIGYGIDLAEDDPWIEAASELANEGLANEASVPGSFWVDTFPFLKYLPSWLPGAEFKRN | 240 |
| Azu_PsiH2 | RQLTDKPDRWSHHIRHQIASMAILDIGYGIDLAEDDPWIEAASELANEGLAVASVPGSFWVDTFPFLKYTIPSWLPGAEFKRN | 234 |
| Cub_PsiH | QQLTKTPDRWAQHIRHQIAAAMSLDIGYGIDLAEDDPWIEATHLANEGLAIASVPGKFWDSFPSIKYILPAWEPGAVFKRK | 234 |
| Cyan_PsiH | RQLTKTPGRWSQHIRHQIAAAMSLDIGYGIDLAEDDPWIEATQLANEGLAIAIASVPGSFWVDSFPSLKYLPSWLPGAGFKRK | 240 |
| Azu_PsiH | RQLIKTPGRWSQHIRHQIAAAMSLDIGYGIDLAEDDPWIEATQLANEGLAIAIASVPGSFWVDSFPSLKYLPSWLPGAGFKRK | 234 |

FIG. 24
CONTINUED

| | | |
|---|---|---|
| Tam_PsiH2 | AKVWKKNTEYMMVNVLYETMKRQTVQGLTRPSYASARLQAMAPDINLEHQERVIKNSASQVIMGGGDTTVSALAAFILAMV | 318 |
| Tam_PsiH | AKTWREGTDHMVDMPYETMKKILHAEGIARPSYAWARLQAMDPNGDLEHQEHVIRNTSTEVNVGGGDTTVSAVSAFILAMV | 318 |
| Cyan_PsiH2 | AKMWKEGADHMVNMPYETMKKLSAQGLTRPSYASARLQAMDPNGDLEHQERVIKNTATQVNVGGGDTTVGAVSAFILAMV | 320 |
| Azu_PsiH2 | AKVWKEGADHMVNMPYERMKKLSAQGLTRPSYASARLQAMDPNGDLEHQERVIKNTATQVNVGGGDTTVGAVSAFILAMV | 314 |
| Cub_PsiH | AKVWREAADHMVDMPYETMRKILAPQGLTRPSYASARLQAMDLNGDLEHQEHVIKNTAAEVNVGGGDTTVSAMSAFILAMV | 314 |
| Cyan_PsiH | ARVWKEGADHMVNMPYETMKKILSAQGIARPSYASARLQAMDPNGDLEHQEHVIKNTATEVNVGGGDTTVSAMSAFILAMV | 320 |
| Azu_PsiH | ARVWKEGADHMVNMPYETMKKILSAQGIARPSYASARLQAMDPNGDLEHQEHVIKNTATEVNVGGGDTTVSAMSAFILAMV | 314 |
| | | |
| Tam_PsiH2 | KYPNVQRKVQAELDAIASQNEIPDFDEENGTMPYLTTACLKEVFRWNQIAPLGITAHRLDKDDSYRGYLIPKGTLVFANIMVA | 398 |
| Tam_PsiH | KYPKVQRKIHQEELDSVLNRGEIPDFDEENDPLPYLITACVKEVFRWNQIAPLATAHRLDKDDVYRGYLIPKGALVFANSMVA | 398 |
| Cyan_PsiH2 | KYPEVQRKVQAELDEFTSKGRIPDFDEDNDSLPYLSACFKELFRWGQIAPLSACFKELFRWGQIAPLATAHRLITKDDVYREYTIPKNALVFANIMVY | 400 |
| Azu_PsiH2 | KYPEVQRKVQAELDEFTSKGRIPDYDEDNDSLPYLSACFKELFRWGQIAPLATAHRLITKDDVYREYTIPKNALVFANIMWA | 393 |
| Cub_PsiH | KYPEVQRKVQAELDALTNNGQIPDYDEEDDSLPYLITACIKELFRWMNQIAPLAIIPHKLMKDDVYRGYLIPKNTLVFANIMVA | 394 |
| Cyan_PsiH | KYPEVQRKAQAELDMLTSKGLIPDYDEEDDSLPYLITACVKELFRWMNQIAPLATAHRLITKDDVYRGYTIPKNALVFANIMVA | 400 |
| Azu_PsiH | KYPEVQRKVQAELDVLTSKGLIPDYDEEDDSLPYLITACVKELFRWMNQIAPLATAHRLITKDDVYRGYTIPKNALVFANIMVA | 394 |

FIG. 24
CONTINUED

| | | |
|---|---|---|
| Tam_PsiH2 | ---TLNDPLMYPNPGEFQPERYLGPDGKHDPSVRDPRKTAFGMGRRACPGIYLAQSTVWHTATMLLSAFNIEPPLNEEGK | 475 |
| Tam_PsiH | ---VLNDPQVYPDPSEFRPERYLDSEGRPDNTVRDPRKAAFGYGRRNICPGIHLAQTTVWIVAATLLQVFNIERPVDANGT | 475 |
| Cyan_PsiH2 | GRITVLNDPSEYPNPSEFRPERYLGPDGKPDTVRDPRKAAFGYGRRVCPGIHLAQSTVWIAGVALVSAFNIELPVDKDGK | 480 |
| Azu_PsiH2 | ---TVLNDPSEYPNPSEFRPERYLGPDGKPDTVRDPRKAAFGYGRRVCPGIHLAQSTVWIAGVALVSAFNIELPVDKDGK | 471 |
| Cub_PsiH | ---VLNDPEVYPDPSVFRPERYLGPDGKPDNTVRDPRKAAFGYGRRNCPGIHLAQSTVWIAGATLLSAFNIERPVDQNGK | 471 |
| Cyan_PsiH | ---VLNDPEEYPDPSEFRPERYLGPDGKPDHTVRDPRKAAFGYGRRTCPGIHLAQSTVWIAGATLLSAFNIVERPVDRTGK | 477 |
| Azu_PsiH | ---VLNDPEEYPDPSEFRPERYLGPDGKPDHTVRDPRKAAFGYGRRTCPGLHLAQSTVWIAGATLLSVFNIERPVDRTGK | 471 |

| | | |
|---|---|---|
| Tam_PsiH2 | PIKVEAAFTTGFFRYSPRSDA*--------- | 497 |
| Tam_PsiH | PIDIPAAFTTGFFRYDRFTRLCHLSDFS*    | 504 |
| Cyan_PsiH2 | CIDIPAAFTTGFFR*---------------  | 495 |
| Azu_PsiH2 | CIDIPAAFTTGFFR*---------------  | 486 |
| Cub_PsiH | PIDIPADFTTGFFR*----------------  | 486 |
| Cyan_PsiH | PIDIPAAFTTGFFR*---------------  | 492 |
| Azu_PsiH | PIDIPAAFTTGFFR*---------------  | 486 |

FIG. 24
CONTINUED

```
GGTACCAGCAGTACCAGCACCAGCCACTGCATTATTGA--ATCTGACATCTGCAACAGCA    58
---------CGATTTCTTTAGGGCCGTAGGCTAGTAATCATCGACCGTTTTAATCATTA    50
--TGCCAAAAAGCCTTCTTGTGGCCTGCTTACTATTA---AGGCAACTAATTCAAGAACA   55
              *  *   ** *    *      *     *   *  *    *

AGGTACA------ATTTTTGTTTTACATTTTACTCATTAATATTAGCACCTATAGCTGTG  112
ATGTACTTAGACAATAAATATAAGATGCAATACAAGTCAATG--GGAGAAACTAGACTTT  108
AGTGATTCTGG--GTAGGTAGATGCCACAGTTCATGATAATAAAGGCGAAGTCAGAAGGA  113
  *          *     *         * *    ***     *        **

GCCAATCTTTTGACGACGACTCTCTCACGCTGGAGGAAAGCATGGTACGGGCATTAA---  169
ACAAAAC-CTTTAAAAGCCCTGGTG-------AGATATGAGAAGGTTTATGACAGAATATA 161
GTAGTCC-GTTGATGAAGAAAGCAG-------AAGGCAAGGAATGTTGGTGGCTTTTGGTT 166
   *  ** *  *                    *  * *  *

TTGCCAGCGTAGAA--------CAAGCGTAGGATATGGGCAACCTCGCTGATTTCTATAT  221
TCGCCATTAATGTGAGGTTGTGGACACTGCTGGTAGTCAAGGCTGCCCGTGAACCATATT  221
GCGGTAGCACTGAAACCGTGTCCGGACTT-----CGCCGGGAGCAGACAATGGCTTGGTT  221
 *  *          *                 *                *      *

TTGGTAAGAAGTCTCACCCCGTGAGCTAAGCAAAAAGCAAAACCCTTGCTATGTCAACAT  281
TAGTCACATGTAATCACCCCGCGTGCTAAACAAAAAGCAAAATATCAGTAAGATAGTCAC  281
GGATTACATAATAATACCCCGCGGGCCAGACAATATTCAAAATCCTAACAAAGATGTCTC  281
   *       ** ****** *  *  *  *** *  *****      *    *   *

CCCACTGCCATACACTATT|GTCCCCTTCGGGGTGACATACGAAAAAATTGGAACGATACA|  341
AGTCATAACACTGTTGTTT|GTCCCCTTCGGGGTGACATACGAAAAAATTGGAACGATACA|  341
AGGTAATACATTCGCTAAT|GTCCCCTTCGGGGTGACATACGAAAAAATTGGAACGATACA|  341
        **         ***********************************************

|GAGAAGATTAGCATGGCCCCTGCACAAGGATGACACGCTTTCCCGGAGTGGTAGATCTAC|  401
|GAGAAGATTAGCATGGCCCCTGCACAAGGATGACACGCTTTCCCGGAGTGGTAGATCTAC|  401
|GAGAAGATTAGCATGGCCCCTGCACAAGGATGACACGCTTTCCCGGAGTGGTAGATCTAC|  401
 ************************************************************

|GGATCTCAATATTTATTTT|  420
|GGATCTCAATATTTATTTT|  420
|GGATCTCAATATTTATTTT|  420
 *******************
```

FIG. 27

5' NNNNGMYGUIDE(Forward) 3'
3' CMYGUIDE(Reverse)CAAA 5'

NNNN is:
GAAT for U6-1
TAAT for U6-2
TATT for U6-3

FIG. 28

GENETICALLY MODIFIED ORGANISMS FOR PRODUCING PSYCHOTROPIC ALKALOIDS

CROSS REFERENCE TO RELATED APPLICATIONS

The present application claims priority to International Application No. PCT/US22/82631, filed Dec. 30, 2022, which claims the benefit of U.S. Provisional Application No. 63/295,735, filed Dec. 31, 2021, U.S. Provisional Application No. 63/295,739, filed Dec. 31, 2021, U.S. Provisional Application No. 63/295,742, filed Dec. 31, 2021, and U.S. Provisional Application No. 63/295,723, filed Dec. 31, 2021, the entire contents of each of which are hereby incorporated by reference in their entirety.

SEQUENCE LISTING

The instant application contains a Sequence Listing which has been submitted electronically in XML format and is hereby incorporated by reference in its entirety. Said XML copy, created on Sep. 22, 2023, is named 200021-701301—Sequence Listing.xml and is 782,336 bytes in size.

BACKGROUND

The World Health Organization estimates that more than 400 million people in the U.S. suffer from a mental health disorder, e.g., severe depression, anxiety, obsessive-compulsive disorder, addiction. While there is no universally effective treatment or cure for mental health disorders, certain alkaloids produced by fungi are showing promising results in achieving positive therapeutic outcomes. Psychotropic alkaloids such as psilocybin, N,N-dimethyltryptamine (DMT), psilocin, are promising therapeutic properties for the treatment of mental health disorders including, severe depression, anxiety, obsessive-compulsive disorder, and addiction. Unfortunately, the feasibility for industrial production of such alkaloids has yet to be realized. Psychotropic alkaloids are only produced in trace amounts by a limited number of fungal species. Thus, synthetic production fungal-derived alkaloids is presently a challenge. Therefore, there is a need for compositions, methods, devices and systems providing for enhanced production of therapeutically relevant fungal-derived alkaloids.

INCORPORATION BY REFERENCE

All publications, patents, and patent applications mentioned in this specification are herein incorporated by reference to the same extent as if each individual publication, patent, or patent application was specifically and individually indicated to be incorporated by reference. Absent any indication otherwise, publications, patents, and patent applications mentioned in this specification are incorporated herein by reference in their entireties.

BRIEF SUMMARY

This disclosure relates to non-naturally occurring organisms with biosynthetic pathways that are genetically engineered to produce one or more desired alkaloids as compared to comparable wild-type organisms. This disclosure also relates to methods of making genetically modified organisms that are rich in one or more alkaloids as compared to a comparable non genetically modified organism. The genetically modified organisms described herein can possess biochemical phenotypes having pharmaceutically relevant alkaloids, and combinations of pharmaceutically relevant alkaloids, which can be useful to treat certain diseases and conditions including mental health disorders. In addition, the genetically modified organisms disclosed herein can facilitate the industrial production of alkaloids by providing efficient and low-cost sources from which alkaloids can be isolated, thereby increasing the availability of otherwise rare alkaloids for therapeutic use.

In some embodiments are engineered fungal cells that comprises a first genetic modification and a second genetic modification, wherein the first genetic modification results in decreased expression of a PsiD gene product; and the second genetic modification results in an increased expression of a protein encoded by a hygromycin resistance gene. In some embodiments, the first genetic modification comprises a modification of a promoter operatively linked to the PsiD gene. In some embodiments, the first genetic modification comprises a genetic modification that induces a frame shift in the PsiD gene such that when the PsiD gene is transcribed and translated, a protein expressed from the PsiD gene that comprises the genetic modification, has diminished function, or is not functional compared to a protein expressed from a comparable PsiD gene that does not comprise the genetic modification. In some embodiments, the first genetic modification comprises excision of the PsiD gene. In some embodiments, the excision is a CRISPR excision. In some embodiments, the second genetic modification comprises a first exogenous polynucleotide that comprises a hygromycin resistance gene. In some embodiments, the first exogenous polynucleotide is stably incorporated into the engineered fungal cell's genome. In some embodiments, the first exogenous polynucleotide is not stably incorporated into the engineered fungal cell's genome. In some embodiments, the first exogenous polynucleotide is not incorporated in the engineered fungal cell's genome. In some embodiments, the first exogenous polynucleotide is comprised in a plasmid present in the engineered fungal cell. In some embodiments, the first exogenous polynucleotide is operably linked to a promoter. In some embodiments, the promoter is CaMV 35S promoter. In some embodiments, the first exogenous polynucleotide is operably linked to a promoter. In some embodiments, the promoter is CaMV 35S promoter. In some embodiments, the engineered fungal cell further comprises a second exogenous polynucleotide that comprises an Indolethylamine N-Methyltransferase (INMT) gene. In some embodiments, the engineered fungal cell comprises an increased amount of an alkaloid compared to a comparable wild-type fungal cell. In some embodiments, the alkaloid is N,N-dimethyltryptamine (DMT). In some embodiments, the increased amount of the alkaloid is determined by a spectrophotometric method. In some embodiments, the engineered fungal cell further comprises a second exogenous polynucleotide that comprises an INMT gene. In some embodiments, the engineered fungal cell comprises an increased amount of an alkaloid compared to a comparable wild-type fungal cell. In some embodiments, the alkaloid is N,N-dimethyltryptamine. In some embodiments, the increased amount of the alkaloid is determined by a spectrophotometric method. In some embodiments, the engineered fungal cell further comprises a second exogenous polynucleotide that comprises an INMT gene. In some embodiments, the engineered fungal cell comprises an increased amount of an alkaloid compared to a comparable wild-type fungal cell. In some embodiments, the alkaloid is N,N-dimethyltryptamine. In some embodiments, the increased amount of the alkaloid is determined by a spectrophotometric method. In some embodiments, the engineered fungal cell further comprises a second exogenous polynucleotide that comprises an INMT gene. In some embodiments, the engineered fungal cell comprises an increased amount of an alkaloid compared to a comparable wild-type fungal cell. In some embodiments, the alkaloid is N,N-dimethyltryptamine. In some embodiments, the increased amount of the alkaloid is determined by a spectrophotometric method. In some embodiments, the engineered fungus is of Basidiomycota. wherein the composition, the engineered fungal cell, or both further comprise a monoamine oxidase inhibitor. In some instances, the monoamine oxidase can be monoamine oxidase A, monoamine oxidase B, or a combination of these. In some embodiments, the alkaloid is isolated and purified. In some embodiments, the engineered fungal cell is comprised in a fungus or a portion thereof.

In one aspect, this disclosure relates to a composition comprising a non-naturally occurring organism such as a genetically modified fungal cell that is engineered to produce a greater quantity of a desired alkaloid as compared to a corresponding naturally occurring fungal cell. The engineered fungal cell can comprise a modification that suppresses or eliminates expression of psilocybin phosphatase in the engineered fungal cell as compared to a comparable fungal cell without said modification. Advantageously, by suppressing or eliminating expression of psilocybin phosphatase, the engineered fungal cell can produce an increased amount of one or more desirable alkaloids as compared to a comparable fungal cell that does not have a modification that suppresses or eliminates expression of psilocybin phosphatase. For example, without being bound to any one embodiment, by suppressing or eliminating expression of psilocybin phosphatase, the engineered fungal cell can possess an altered biosynthetic pathway in which the conversion of psilocybin into psilocin is significantly reduced or eliminated. By reducing the conversion of psilocybin to psilocin, the engineered fungal cell can provide a greater amount of psilocybin, or a derivative or precursor of psilocybin, as compared to a comparable wild-type fungal cell in which a significant portion of the biosynthesized psilocybin is converted into psilocin. Accordingly, provided herein are methods and compositions for making, and using engineered fungal cells that are bountiful in one or more otherwise rare alkaloids in the psilocybin pathway.

In one aspect, this disclosure provides a composition that comprises an engineered fungal cell comprising a genetic modification that results in an increased expression of at least 6-fold of an alkaloid, or a precursor thereof, as compared to a comparable fungal cell devoid of said genetic modification. The engineered fungal cell can comprise a genetic modification that results in at least a 6-fold increase in expression of mRNA encoding L-tryptophan decarboxylase in the engineered fungal cell as compared to a comparable fungal cell that is devoid of said genetic modification, thereby resulting in higher production of one or more alkaloids. In some cases, the fungal cell is from division Basidiomycota. In some embodiments, the fungal cell is a mycelial cell. In some embodiments, the fungal cell can be a mycelium cell that is part of fungal hyphae comprising a plurality of such mycelium cells. In some instances, upregulation of L-tryptophan decarboxylase, for instance by upregulation of the PsiD gene, results in increased expression of one or more of tryptamine or 4-hydroxytryptamine, as compared to a wild-type mycelium. By increasing the expression of L-tryptophan decarboxylase, the engineered mycelium can also produce an increased amount of a number of alkaloids that appear in a biosynthetic pathways downstream of tryptamine and/or 4-hydroxytryptamine, such as, psilocybin, psilocin, baeocystin, norbaeocystin, aeruginascin, tryptamine, or N,N-dimethyltryptamine. Accordingly, genetically modified fungal cells described herein can produce an entourage of alkaloids that, in combination, can enhance the therapeutic effect.

This disclosure further provides compositions and methods for genetically modifying organisms to increase the production of new or rare alkaloids.

In one aspect, this disclosure provides a gene editing system for enhanced expression of a psychotropic alkaloid in a fungal cell. The system comprises an endonuclease and at least one guide polynucleotide, or one or more nucleic acids encoding the endonuclease and the at least one guide polynucleotide, wherein the guide polynucleotide binds to a nucleic acid that encodes or regulates a gene that modulates production of a psychotropic alkaloid in a fungal cell. The system further comprises a reagent that increases incorporation of the endonuclease or the at least one guide polynucleotide, or the one or more nucleic acids encoding the endonuclease or the at least one guide polynucleotide, into the fungal cell as compared to the incorporation without the reagent. In some embodiments, the fungal cell is a fungal protoplast. In some embodiments, the system the comprises one or more nucleic acids encoding the gene editing system. In some embodiments, the one or more nucleic acids comprise non-replicating DNA. In some embodiments, the system comprises the endonuclease and the at least one guide polynucleotide in the format of an active ribonucleoprotein. In some embodiments, the reagent comprises a nonionic surfactant, a lipid nanoparticle, or an agent that depolymerizes microtubules. In some embodiments, the reagent comprises:

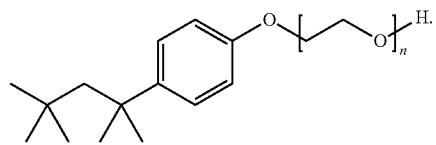

In some embodiments the reagent has a molecular mass of 647 grams/mole. In some instances, n can be: 1, 2, 3, 4, 5, 6, 7, 8, 9, 10, 11, 12, 13, 14, 15, 16, 17, 18, 19, 20, 21, 22, 23, 24, or 25.

In another aspect, this disclosure provides gene editing systems for genetically modifying a fungal cell, wherein the system comprises an endonuclease and at least one guide polynucleotide, or one or more nucleic acids encoding said endonuclease and the at least one guide polynucleotide, wherein the guide polynucleotide comprises a sequence that can bind to a gene that comprises a sequence comprising one of SEQ ID NOS: 29-87, wherein, binding of the guide polynucleotide to the gene in a fungal cell leads to a genetic modification that modulates production of one or more alkaloids. In some embodiments, the guide polynucleotide comprises a sequence that is complementary to an alkaloid synthase gene. In some embodiments, the guide polynucleotide binds to one of the gene sequences listed in TABLE 1 or TABLE 2. In some embodiments, the gene sequence comprises a gene sequence in TABLE 1 or TABLE 2. In some embodiments, the gene sequence comprises any one of SEQ ID NOs: 1-19, 67 90-99, or 151. In some embodiments, the gene sequence has a 95% percent identity to any one of SEQ ID NOs: 1-19, 67 90-99, or 151. In some embodiments, the gene sequence has a 99% percent identity to any one of SEQ ID NOs: 1-19, 67 90-99, or 151. In some embodiments, the gene sequence is any one of SEQ ID NOs: 1-19, 67, 90-99, or 151.

In another aspect, this disclosure provides gene editing systems for genetically modifying a fungal cell, wherein the system comprises an endonuclease and at least one guide polynucleotide, or one or more nucleic acids encoding said endonuclease and the at least one guide polynucleotide, wherein the guide polynucleotide comprises a sequence that can bind to a gene that comprises a sequence comprising one of SEQ ID NOS: 29-87, wherein, binding of the guide polynucleotide to the gene in a fungal cell leads to a genetic modification that modulates production of one or more alkaloids. In some embodiments, the guide polynucleotide comprises a sequence in TABLE 9-16. In some embodiments, the guide polynucleotide binds to a sequence listed in TABLE 9-16. In some embodiments, the guide polynucleotide binds a sequence selected from the group consisting of SEQ ID NOs: 29-87. In some embodiments, the guide polynucleotide comprises a sequence selected from the group consisting of SEQ ID NOs: 29-87.

In another aspect, this disclosure provides a gene editing system for genetically modifying a fungal cell, the system comprising at least one nucleic acid sequence encoding a guide polynucleotide that binds to a nucleic acid involved in expression or regulation of a psychotropic alkaloid, wherein the at least one nucleic acid sequence is operably linked to a first gene promoter, and a nucleic acid sequence encoding an endonuclease operably linked to a second gene promoter, wherein the second gene promoter is distinct from the first gene promoter, wherein when the gene editing system is expressed in the fungal cell, the gene editing system introduces a genetic modification into the genome of the fungal cell. The first gene promoter and the second gene promoter can have different promoter activities. In some embodiments, the first gene protomer is a U6 gene promoter. In some embodiments, the second gene promoter is a GDP gene promoter.

In another aspect, this disclosure provides a gene editing system for multiplex gene engineering of a fungal cell, the system comprising a vector encoding at least two guide polynucleotides that each bind to a nucleic acid that encodes or regulates a gene that modulates production of a psychotropic alkaloid in a fungal cell, and an endonuclease. When the at least two guide polynucleotides and the endonuclease are expressed in a fungal cell, the at least two guide polynucleotides and the endonuclease introduce a genetic modification into the genome of the fungal cell that modulates expression of an alkaloid. In some embodiments, the vector is a bacterial vector. In some embodiments, the vector comprises border sequences that facilitates the incorporation of at least a portion of the vector into the fungal cell by a bacterium.

In another aspect, this disclosure provides a kit comprising a gene editing system as described herein for genetically modifying a fungal cell. In some instances, the kit can comprise a container. The kit can include reagents for delivering the gene editing system into the fungal cell. The kit may also include instructions.

In another aspect, this disclosure provides a method for genetically modifying a fungal cell. The method includes introducing a gene editing system as described herein into a fungal cell. In some embodiments, the method further includes expressing the gene editing system inside the fungal cell, wherein expression of the gene editing system inside the fungal cell results in a genetic modification that leads to the increased production of one or more psychotropic alkaloids as compared to a fungal cell devoid of said gene editing system.

In one aspect, this disclosure provides a composition including an engineered fungal cell comprising a first genetic modification, for instance in a PsiD gene, that results in increased expression of L-tryptophan decarboxylase in the engineered fungal cell as compared to a comparable fungal cell without the genetic modification and a second genetic modification that results in decreased expression of psilocybin phosphatase in the engineered fungal cell as compared to a comparable fungal cell without the second genetic modification. In some embodiments, the fungal cell is from the division Basidiomycota.

In one aspect, this disclosure provides an engineered fungus comprising a genetic modification, for instance in a PsiD gene, that results in an increased expression of L-tryptophan decarboxylase, wherein the increased expression of L-tryptophan decarboxylase results in an increased amount of alkaloid production in the fungus that in turn results in the engineered fungus or a portion thereof changing from a first color to a second color upon exposure to air for instance as a result of oxidation reactions of one or more alkaloids, wherein the second color is visually distinct from a corresponding portion of a comparable non-engineered fungus upon an equivalent exposure to air. The second color can comprise a blue coloration that is distinct from a blue coloration of a wild-type fungus.

In one aspect, this disclosure provides a method comprising introducing an exogenous nucleic acid encoding L-tryptophan decarboxylase, for instance a PsiD gene, into a fungal cell, growing the fungal cell into a mycelial mass, and expressing L-tryptophan decarboxylase in the mycelial mass, wherein the presence of the exogenous nucleic acid results in the mycelial mass expressing L-tryptophan decarboxylase in an amount that is greater than a comparable mycelial mass without said exogenous nucleic acid which in turn results in greater expression of one or more alkaloids such as psilocybin from said mycelial mass. For example, in some embodiments, the expression of the exogenous nucleic acid results in at least a 6-fold increase in expression of L-tryptophan decarboxylase in the mycelial mass as compared to a comparable wild-type mycelial mass. Advantageously, the unregulated expression of L-tryptophan decarboxylase in the mycelial mass results in an increased production of one or more psychotropic or non-psychotropic alkaloids, e.g., psilocybin, by the genetically modified mycelial mass as compared to a comparable wild-type mycelium. In some embodiments, the one or more psychotropic alkaloids can be isolated directly from the mycelial mass before the mycelial mass produces mushrooms, thereby allowing for a more rapid, cost-effective, approach to harvesting one or more psychotropic alkaloids.

In one aspect, this disclosure provides a method comprising obtaining a genetically modified organism comprising a genetic modification, wherein the genetic modification results in increased expression of L-tryptophan decarboxylase, for instance by upregulation of the PsiD gene or introducing an exogenous PsiD gene, as compared to a comparable organism without the genetic modification and detecting, from a tissue of the genetically modified organism a change from a first color to a second color upon exposure to air, wherein the second color is visually distinct from tissue of a comparable organism upon an equivalent exposure of air.

BRIEF DESCRIPTION OF THE DRAWINGS

The novel features of the present disclosure are set forth with particularity in the appended claims. A better understanding of the features and advantages of the present disclosure can be obtained by reference to the following detailed description that sets forth illustrative embodiments, in which the principles of the disclosure are utilized, and the accompanying drawings of which:

FIGS. 16A and 16B show LC-MS data on quinoid and quinoid dimers. Samples 1771 and 1772 are from transgenic fungi. Sample 1773 is from a comparable wild type control.

FIG. 17A shows relative amounts of 4-hydroxytryptamine. FIG. 17B shows relative amounts of 4-hydroxytrimethyltryptamine. FIG. 17C show relative amounts of aeruginascin. FIG. 17D is a chart showing data of FIGS. 17A through 17C.

FIG. 18A shows blue transgenic fungal cells with enhanced PsiD and PsiK expression. FIG. 18B shows a mycelial mass comprised of transgenic cells overexpressing PsiD (with blue coloration) in comparison with wild-type mycelial mass (no coloration). FIG. 18C shows a mycelial mass comprised of transgenic cells with enhanced PsiD and PsiK expression cultured to primordia formation after 7 days with visible pinheads appearing after 5 days shown growing from the mycelia.

FIG. 21A shows a pathway from bacteria, which is used to produce a β-carboline scaffold from L-tryptophan. FIG. 21B shows a related pathway from a plant, which involves condensation of tryptamine and secologanin to produce a tetrahydro-β-carboline compound.

FIG. 23 shows a comparison of PsiM gene products from four different psilocybin-producing fungal species. Figure discloses SEQ ID NOS 722-725, respectively, in order of appearance.

FIG. 24 shows a sequence alignment comparing PsiH and PsiH2 gene products from four different psilocybin-producing fungi. Figure discloses SEQ ID NOS 726-727, 22, and 728-731, respectively, in order of appearance.

FIG. 27 shows an illustration on guide oligo design. Figure discloses SEQ ID NOS 732-734, respectively, in order of appearance.

FIG. 28 shows an alignment of three U6 promoters used in the cloning system.

FIG. 31B shows a graphical representation of PcINMT expression in selected transgene copy lines.

FIG. 32A show an image of a molecular ladder evaluating TrpM expression. FIG. 32B and FIG. 32C show graphical representations of TrpM expression including TrpM expression of a strain comprising multiple transgene copies (TrpM-03).

DETAILED DESCRIPTION

Figure 1:
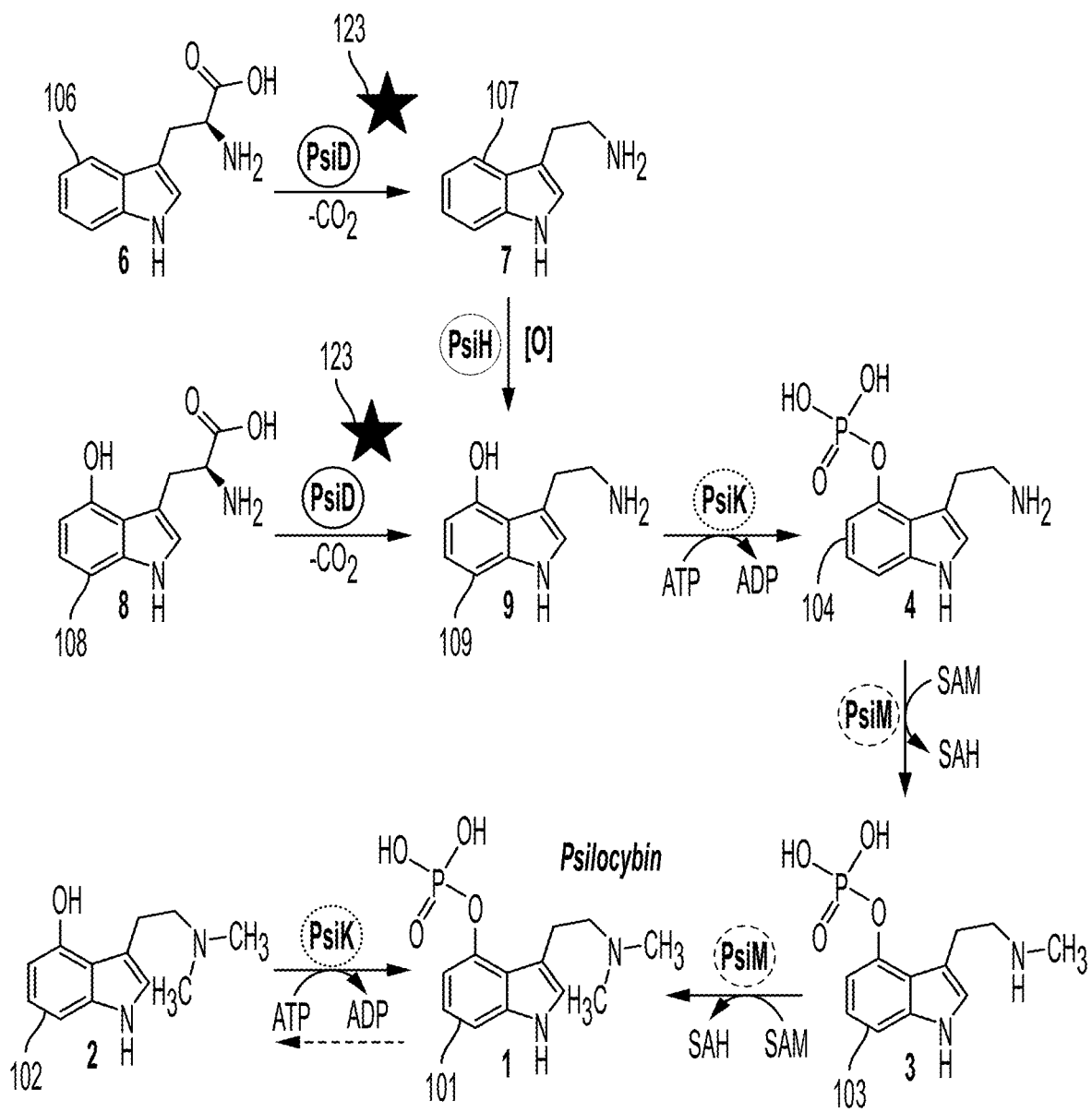
FIG. 1 illustrates an alkaloid biosynthesis pathway of a genetically modified organism with a genetic modification that upregulates expression of tryptophan decarboxylase.

This disclosure relates to genetically modified organisms, and methods of making and using the same, that are useful for producing one or more alkaloids. In particular, this disclosure relates to organisms that are genetically modified to possess markedly different characteristics as compared to comparable wild-type organisms found in nature. As such, the genetically modified organisms of this disclosure are not naturally occurring. The non-naturally occurring genetically modified organisms described herein are, by way of one or more genetic modifications, useful for producing alkaloids with desirable properties. The one or more genetic modifications can provide new or enhanced biosynthetic routes that lead to the production of the one or more desired alkaloids. The one or more desired alkaloids made by the genetically modified organisms described herein can be produced in quantities that cannot be found in comparable wild-type organisms. Accordingly, this disclosure provides genetically modified organisms that are richer in desired alkaloids than a comparable organism found in nature.

According to this disclosure, a genetically modified organism can be designed to include a biosynthetic pathway that produces one or more desired alkaloids. For example, the biosynthetic pathway can be engineered to produce elevated amounts of a desired alkaloid or desired combinations of alkaloids. The alkaloids may be desired for their beneficial biological properties. For example, without limiting the scope of the disclosure, a desired alkaloid may exhibit antiproliferation, antibacterial, antiviral, anticancer, insecticidal, antimetastatic, or anti-inflammatory effects. Accordingly, a genetically modified organism produced by methods described herein can possess a biosynthetic pathway that results in the production of alkaloids with known or suspected beneficial properties. In some embodiments, the desired alkaloids compounds can include tryptophan derived compounds. In some embodiments, the alkaloids can include tryptamine-derived compounds.

Tryptamine-derived compounds include a large group of monoamine alkaloids, which are derived from amino acid tryptophan. Some tryptamine-derived compounds can be found in trace amounts in naturally occurring organisms including some plants, fungi, microbes, and *amphibia*. For example, psilocybin and psilocin are tryptamine-derived compounds which can be found in in some fungal species such as *Psilocybe cubensis*. Recently some of these compounds have gained attention for their therapeutic significance. For example, clinical studies have revealed positive outcomes of tryptamine-derived compounds in the treatment of existential anxiety, in the treatment of nicotine addiction, in the treatment of major depressive disorder, as well as other psychiatric diseases and disorders. However, due to the cost and rarity of naturally occurring tryptamine derived compounds, clinical research studies and wide-spread access to clinically relevant tryptamine derived compounds have remained limited. While some synthetic approaches to producing tryptamine derivatives have been developed, such approaches generally rely on serial production of one derivative developed at a time, which is inefficient and costly. Moreover, reports show that administration of single derivatives fail to achieve the same positive clinical outcomes as can be accomplished by administering fungal extracts which contain a suite of various tryptamine derived compounds. The enhanced clinical effect of combinations of alkaloids is sometimes referred to as the entourage effect, which cannot be achieved by current synthetic approaches. Therefore, there remains a need for methods of producing bioderived alkaloids (e.g., tryptamine derived compounds) that are rare and/or novel with a unified engineering approach.

This disclosure helps address that need with genetically modified organisms, for instance modifying organisms with upregulation of the PsiD gene or introduction an exogenous PsiD gene, and methods of making genetically modified organisms, which possess biochemical phenotypes that are rich in desirable tryptamine derived compounds. This disclosure also provides methods to modulate production of specific compounds within the genetically modified organism. For example, methods described herein can be implemented to upregulate or downregulate expression of one or more compounds with high specificity. Accordingly, methods described herein can be used to tailor biosynthetic pathways of organisms to produce genetically modified organisms that can produce increased quantities of certain compounds of interest such as psilocybin. Because the production is carried out in a genetically modified organism, a production method is provided which can be optimized, tailored, and controlled in any desired manner. The present disclosure also provides efficient production of alkaloids and makes it possible to scale up the production method to an industrial scale. For example, the production of one or more alkaloids in a genetically modified organism described herein can make use of large-scale bioreactors or production systems to provide a consistent, cheap, and high level of production. Moreover, alkaloids produced by the methods described herein can be used or formulated into selected compositions, such as a pharmaceutical composition, and even provided in single dose format.

Any gene described herein may independently have a percentage sequence identity of about: 80%, 85%, 90%, 91%, 92%, 93%, 94%, 95%, 96%, 97%, 98%, 99%, or 100%. Any gene described herein may independently have a percentage sequence identity of up to: 80%, 85%, 90%, 91%, 92%, 93%, 94%, 95%, 96%, 97%, 98%, 99%, or 100%. Any gene described herein may independently have a percentage sequence identity of at least: 80%, 85%, 90%, 91%, 92%, 93%, 94%, 95%, 96%, 97%, 98%, 99%, or 99.9%.

This disclosure provides gene editing systems, compositions, and methods for genetically modifying organisms for the production of alkaloids. This disclosure provides gene editing systems that, when expressed in an organism, result in a genetic modification that leads to the increased production of one or more desired alkaloids. The result of the genetic modification introduced by a system, composition or a method described herein is a genetically modified organism that possess a markedly different characteristics as compared to comparable wild-type organism found in nature. As such, systems, compositions and methods of this disclosure can produce genetically modified organisms that are not naturally occurring. The non-naturally occurring genetically modified organisms described herein are, by way of one or more genetic modifications, useful for producing alkaloids with desirable properties. In particular, the systems, compositions and methods described herein can produce genetically modified organisms with new or enhanced biosynthetic pathways that lead to the production of the one or more desired alkaloids. The one or more desired alkaloids as described herein can be new to nature or produced in quantities that cannot be found in comparable wild-type organisms.

This disclosure further relates to gene editing systems and methods that can precisely modify genetic material in eukaryotic cells, which enables a wide range of high value applications in medical, pharmaceutical, drug discovery, agricultural, basic research and other fields. Fundamentally, the genome editing systems and methods provided herein enable the capability to introduce, or remove, one or more nucleotides at specific locations in eukaryotic genomes. The genome editing systems also allow for the ability to incorporate exogenous nucleic acids, sometimes referred to as a donor sequence, into an organism for expression by the organism. Accordingly, this disclosure provides gene editing systems and methods thereof that allow for targeted edits, such as deleting, inserting, mutating, or substituting specific nucleic acid sequences, of an organism to produce a genetically modified organism. Organisms genetically modified by a gene editing system, composition, or method described herein can provide a source of a new or rare drug such as one or more fungal derived alkaloids. The organism can be a fungal cell from division Basidiomycota. The fungal cell can be a fungal protoplast.

This disclosure further relates to compositions and methods for genome engineering with a gene-editing system, for example a CRISPR enzyme-based gene editing system. This disclosure provides compositions and methods useful to genetically modify an organism, such as, a fungal protoplast, with a gene editing system. In some embodiments, this disclosure relates to the discovery that Cas endonucleases can be used in the fungal kingdom in combination with guide polynucleotides and donor sequences to provide a toolbox of options from which to pick and choose genetic modifications that can result in genetically modified biosynthetic pathways that produce new or rare alkaloidal compounds. In some embodiments, this disclosure provides codon optimized tools for genetically modifying a fungal cell with a CRISPR system. In some embodiments, the alkaloids produced are new to nature alkaloids with significant clinical value.

In some embodiments, this disclosure provides a platform of compositions and methods involving gene editing systems which have particular applicability to organisms that already possess biosynthetic pathways for producing clinically relevant compounds. Accordingly, in some embodiments, this disclosure provides a drug discovery platform that can produce genetic modifications resulting in altered biosynthetic pathways that lead to the production of new compounds, which is useful for drug discovery.

This disclosure also provides certain sequences useful for targeting a polynucleotide guided endonuclease. The sequences can be used to design guide polynucleotides that target a gene editing system to a gene involved in alkaloid production for editing. The targeted edits described herein can be used to create a new biosynthetic pathway within the organism that produces one or more desired alkaloids. For example, the biosynthetic pathway can be engineered with the gene editing system to produce elevated amounts of a desired alkaloid or desired combinations of alkaloids.

The alkaloids produced by genetically modified organism described herein may be desired for their beneficial biological properties. For example, without limiting the scope of the disclosure, a desired alkaloid may exhibit antiproliferation, antibacterial, antiviral, anticancer, insecticidal, antimetastatic, or anti-inflammatory effects. Accordingly, a genetically modified organism produced by methods described herein can possess a biosynthetic pathway that results in the production of alkaloids with known or suspected beneficial properties. In some embodiments, the desired alkaloids compounds can include tryptophan derived compounds. In some embodiments, the alkaloids can include tryptamine-derived compounds.

This disclosure also provides compositions and methods having gene editing systems that can be used on fungal cells to produce a genetically modified fungal cell possessing a biochemical phenotype that is rich in one or more desirable alkaloids. This disclosure also provides compositions and methods to modulate production of specific alkaloids within the genetically modified fungal cell. For example, methods described herein can be implemented to upregulate or downregulate production of one or more alkaloids with high specificity by virtue of one or more nucleic acid guided gene editing systems. Accordingly, methods described herein can be used to tailor biosynthetic pathways of fungal cells to produce genetically modified fungal cells that can produce increased quantities of certain alkaloids of interest. Because the production is carried out in a genetically modified fungal cell, a production method is provided which can be optimized, tailored, and controlled in any desired manner.

The following discussion of the present disclosure has been presented for purposes of illustration and description. The following is not intended to limit the invention to the form or forms disclosed herein. Although the description of the present disclosure has included description of one or more embodiments and certain variations and modifications, other variations and modifications are within the scope of the present disclosure, e.g., as may be within the skill and knowledge of those in the art, after understanding the present disclosure. It is intended to obtain rights which include alternative embodiments to the extent permitted, including alternate, interchangeable and/or equivalent structures, functions, ranges or steps to those claimed, whether or not such alternate, interchangeable and/or equivalent structures, functions, ranges or steps are disclosed herein.

The section headings used herein are for organizational purposes only and are not to be construed as limiting the subject matter described.

Although various features of the disclosure may be described in the context of a single embodiment, the features can also be provided separately or in any suitable combination. Conversely, although the disclosure may be described herein in the context of separate embodiments for clarity, various aspects and embodiments can be implemented in a single embodiment.

Definitions

As used herein, an "alkaloid" and a "psychotropic alkaloid" are used interchangeably to refer to any of a class of nitrogenous organic compounds of plant or fungal origin which have a physiological effect on a subject, such as a human subject. In some embodiments, the alkaloids can include tryptophan-derived alkaloids. In some embodiments, the alkaloids can include tryptamine-derived alkaloids. Exemplary alkaloids can include psilocybin, psilocin, norpsilocin, tryptamine, 4-hydroxytryptamine, N,N-dimethyltryptamine, baeocystin, norbaeocystin, serotonin, melatonin, melanin, N-acetyl-hydroxytryptamine, 4-hydroxy-L-tryptophan, 5-hydroxy-L-tryptophan, 7-hydroxy-L-tryptophan, 4-phosphoryloxy-N,N-dimethyltryptamine, serotonin, aeruginascin, 2-(4-Hydroxy-1H-indol-3-yl)-N,N,N-trimethylethane-1-aminium, 4-phosphoryloxy-N,N-dimethyltryptamine, ketamine, normelatonin, 3,4-methylenedioxymethamphetamine, β-carboline, or any derivative or any analogue thereof.

As used herein, a "biosynthetic pathway" refers to a multi-step, enzyme-catalyzed process whereby a substrate can be converted into a compound (e.g., an alkaloid) in a living organism, such as a genetically modified organism. In biosynthesis, e.g., alkaloid biosynthesis, the substrate can be modified, in some instances, converted into another compound, such as a tryptophan derived alkaloid, via a biosynthetic pathway.

As used herein, a "cell" refers to a biological cell. Some non-limiting examples include: a prokaryotic cell, eukaryotic cell, a bacterial cell, an archaea cell, a cell of a single-cell eukaryotic organism, a protozoa cell, a cell from a plant, an algal cell, a fungal cell, a fungal protoplast cell, an animal cell, and the like. Sometimes a cell is not originating from a natural organism, e.g., a cell can be a synthetically made, sometimes termed an artificial cell.

As used herein, "Cas9" refers to an RNA guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casnl nuclease or a CRISPR (clustered regularly interspaced short palindromic repeat) associated nuclease. An exemplary Cas9, is *Streptococcus pyogenes* Cas9 (spCas9).

As used herein, "disease" or "disorder" is meant any condition that damages or interferes with the normal function of a cell, tissue, or organ. Exemplary disorders include severe anxiety and addiction.

The term "effective amount" or "therapeutically effective amount" as used herein refers to an amount that is sufficient to achieve or at least partially achieve a desired effect. For example, an effective amount can include an amount that when administered to a subject reduces a symptom of a disease or condition or disorder, such as a mental health disorder. In other instances, an effective amount can include an amount that when administer to a subject prevents an unwanted disease or condition or disorder, such as a mental health disorder.

The term "exogenous nucleic acid", "exogenous nucleic acid sequence", or "exogenous polynucleotide" refers to a nucleic acid or genetic material that was transferred into a cell or organism that originated outside of the cell or organism. An exogenous nucleic acid can be synthetically produced. An exogenous nucleic acid can be naturally produced, for example, from a different organism of the same species or from a different organism of a different species. An exogenous nucleic acid can be another copy of a nucleic acid that is similar to an endogenous nucleic acid into which the exogenous nucleic acid is incorporated.

As used herein, an "excipient" includes functional and non-functional ingredients in a pharmaceutical composition. The excipient can be an inactive substance that serves as a vehicle or medium for an alkaloid or other compound disclosed herein.

As used herein, "expression" includes any step involved in the production of a polypeptide in a host cell, e.g., RNA, in a cell or organism including, but not limited to, transcription, translation, post-translational modification, and secretion. Expression can further refer to a process by which information from a nucleic acid (e.g., an exogenous nucleic acid comprising a gene) is used in the synthesis of a functional gene product that enables production of an end product.

The term "functional mushroom," as used herein, refers to fungal species, derivatives, extracts, and mixtures thereof that have nutritional and/or health benefits. Functional mushrooms include medicinal mushrooms, and adaptogenic mushrooms. Examples of functional mushrooms include, but are not limited to, reishi mushroom, and lion's mane mushroom.

The term "gene," as used herein, refers to a nucleic acid (e.g., DNA, such as genomic DNA or cDNA) and its corresponding nucleotide sequence that encodes a gene product, such as an RNA transcript. The term as used herein with reference to genomic DNA includes intervening, non-coding regions as well as regulatory regions. In some uses, the term encompasses the transcribed sequences, including 5 and 3 untranslated regions (5'-TR and 3'-UTR), exons and introns and in some genes, the transcribed region can contain "open reading frames" that encode polypeptides. In some uses of the term, a "gene" comprises only the coding sequences (e.g., an "open reading frame" or "coding region") necessary for encoding a polypeptide. In some cases, genes do not encode a polypeptide, for example, ribosomal RNA genes (rRNA) and transfer RNA (tRNA) genes. In some cases, the term "gene" includes not only the transcribed sequences, but in addition, also includes non-transcribed regions including upstream and downstream regulatory regions, enhancers and promoters A gene can refer to an "endogenous gene" or a native gene in its natural location in the genome of an organism. A gene can refer to an "exogenous gene" or a non-native gene.

The term "gene editing" and its grammatical equivalents as used herein refers to a genetic engineering method or a genetic modification in which one or more nucleotides are inserted, replaced, or removed from a genome of a cell or organism. For example, gene editing can be performed using a nuclease (e.g., a natural-existing nuclease or an artificially engineered nuclease).

The term "gene knock-out" or "knock-out" as used herein refers to any genetic modification that reduces the expression of the gene being "knocked out." Reduced expression includes no expression. The genetic modification can include a genomic disruption.

The term "genetically modified", "genetically engineered", "transgenic", "genetic modification," "non-naturally occurring", and its grammatical equivalents as used herein refers to one or more alterations of a nucleic acid and can be used interchangeably, e.g., the nucleic acid within an organism's genome. For example, genetic modification can refer to alterations, additions, and/or deletion of one or more genes. A genetically modified cell can also refer to a cell with an added, deleted and/or altered gene.

The term "genetic disruption" or "disrupting", and its grammatical equivalents as used herein refers to a process of altering a gene, e.g., by deletion, insertion, mutation, rearrangement, or any combination thereof. For example, a gene can be disrupted by knockout. Disrupting a gene can be partially reducing or completely suppressing expression (e.g., mRNA and/or protein expression) of the gene. Disrupting can also include inhibitory technology, such as shRNA, siRNA, microRNA, dominant negative, or any other means to inhibit functionality or expression of a gene or protein.

As used herein, "guide RNA" or "gRNA" refers to a polynucleotide which is specific for a target sequence and can form a complex with a polynucleotide programmable nucleotide binding domain protein (e.g., Cas9 or Cpf1).

The term "nucleotide," as used herein, generally refers to a base-sugar-phosphate combination. The nucleotide can be composed of three subunit molecules: a nucleobase, a five-carbon sugar (ribose or deoxyribose), and a phosphate group consisting of one to three phosphates. The four nucleobases in DNA can include guanine, adenine, cytosine and thymine; in RNA, uracil can be used in place of thymine. A nucleotide can comprise a synthetic nucleotide. A nucleotide can comprise a synthetic nucleotide analog. Nucleotides can be monomeric units of a nucleic acid sequence (e.g., deoxyribonucleic acid (DNA) or ribonucleic acid (RNA)).

The term "phenotype" and its grammatical equivalents as used herein refers to a composite of an organism's observable characteristics or traits, such as its morphology, development, biochemical or physiological properties, phenology, behavior, and products of behavior. Depending on the context, the term "phenotype" can sometimes refer to a composite of a population's observable characteristics or traits.

As used herein, the term "plant" includes a whole plant and any descendant, cell, tissue, or part of a plant. A class of plant that can be used in the present disclosure can be generally, as broad as the class of higher and lower plants amenable to mutagenesis including angiosperms (monocotyledonous and dicotyledonous plants), gymnosperms, ferns and multicellular algae. Thus, "plant" includes dicot and monocot plants.

As used herein, "protoplast: refers to an isolated cell whose cell wall has been removed. A protoplast can be generated by tripping the cell wall from a plant, bacterial, or fungal cell by mechanical, chemical, or enzymatic means.

As used herein, the terms "protein", "peptide" and "polypeptide" are used interchangeably to designate a series of amino acid residues connected to each other by peptide bonds between the alpha-amino and carboxy groups of adjacent residues. The terms "protein", "peptide" and "polypeptide" refer to a polymer of amino acids, including modified amino acids (e.g., phosphorylated, glycated, glycosylated, etc.) and amino acid analogs, regardless of its size or function. "Protein" and "polypeptide" are often used in reference to relatively large polypeptides, whereas the term "peptide" is often used in reference to small polypeptides, but usage of these terms in the art overlaps. The terms "protein", "peptide" and "polypeptide" are used interchangeably herein when referring to a gene product and fragments thereof.

The term "transgene" refers to a gene or genetic material that can be transferred into an organism that originates from outside the organism. A transgene can include a stretch or a contiguous segment of nucleic acid encoding a gene product that is artificially introduced into an organism. The gene or genetic material can be from a different species. The gene or genetic material can be synthetic. When a transgene is transferred into an organism, the organism can then be referred to as a transgenic organism. A transgene can retain its ability to produce RNA or polypeptides (e.g., proteins) in a transgenic organism. A transgene can comprise a polynucleotide encoding a protein or a fragment (e.g., a functional fragment) thereof. The polynucleotide of a transgene can be an exogenous polynucleotide. A fragment (e.g., a functional fragment) of a protein can comprise at least or at least about: 5%, 10%, 20%, 30%, 40%, 50%, 60%, 70%, 80%, 90%, 95%, or 99% of the amino acid sequence of the protein.

As used herein, "transgenic organisms", generally refer to recombinant organisms in which a desired DNA sequence or genetic locus within the genome of an organism is modified by insertion, deletion, substitution, or other manipulation of nucleotide sequences.

As used herein, the term "transgenic plant" refers to a plant or progeny plant of any subsequent generation derived therefrom, wherein the DNA of the plant or progeny thereof contains an introduced exogenous DNA segment not naturally present in a non-transgenic plant of the same strain. The transgenic plant may additionally contain sequences which are native to the plant being transformed, but wherein the "exogenous" gene has been altered in order to alter the level or pattern of expression of the gene, for example, by use of one or more heterologous regulatory or other elements.

As used herein, a gene sequence can refer to "unmasked" when the sequence does not include any linker or promoter sequences.

As used herein, a "vector" or a "plasmid" is a polynucleotide (e.g., DNA or RNA) and can be used as a vehicle to carry genetic material into a cell, where it can be replicated and/or expressed. In some embodiments, a vector is *agrobacterium* transformation vector. In some instances, the vector is a yeast artificial chromosome, phagemid, bacterial artificial chromosome, virus, or linear DNA (e.g., linear PCR product), for example, or any other type of construct useful for transferring a polynucleotide sequence into another cell. A vector (or portion thereof) can exist transiently (i.e., not integrated into the genome) or stably (i.e., integrated into the genome) in the target cell. In some embodiments, a vector can further comprise a selection marker or a reporter.

References to a percentage sequence identity between two nucleotide sequences means that, when aligned, that percentage of nucleotides are the same in comparing the two sequences. This alignment and the percent homology or sequence identity can be determined using software programs know in the art, for example those described in section 7.7.18 of Current Protocols in Molecular Biology (F. M. Ausubel et al, eds., 1987) Supplement 30, which is incorporated by reference. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in Smith & Waterman (1981) Adv. Appl. Math. 2: 482-489, which is incorporated by reference.

As used herein, "substantially pure" means sufficiently homogeneous to appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound may, however, be a mixture of stereoisomers. In such instances, further purification might increase the specific activity of the compound. In some embodiments, the compositions of the present disclosure are substantially pure.

As used herein, "wild type" or "wild-type organism" refers to an organism that has a genotype or a phenotype of a typical organism of a species as it occurs in nature.

Unless otherwise stated, structures depicted herein are also meant to include all isomeric (e.g., enantiomeric, diastereomeric, geometric (or conformational) forms of the structure; for example, the R and S configurations for each asymmetric center, (Z) and (E) double bond isomers, and (Z) and (E) conformational isomers. Therefore, single stereochemical isomers as well as enantiomeric, diastereomeric, and geometric (or conformational) mixtures of the present compounds are within the scope of the disclosure.

Although various features of the disclosure may be described in the context of a single embodiment, the features can also be provided separately or in any suitable combination. Conversely, although the disclosure may be described herein in the context of separate embodiments for clarity, various aspects and embodiments can be implemented in a single embodiment.

Overview

Genetically Modified Organisms

In some embodiments, a genetically modified organism provided herein is a multicellular organism. In some embodiments, a genetically modified organism is a unicellular organism. embodiments, the genetically modified organism is a single plant cell or a single fungal cell. Embodiments described herein also include populations of cells, for instance a population of cells from a fungal species. For example, in some embodiments, the genetically modified organism comprises a population of genetically modified fungal cells that collectively form a mycelial mass. In some embodiments, a genetically modified organism as described herein is a fungus. For example, in some cases, the genetically modified organism provided herein is a fungal cell. In some cases, the fungus or fungal cell is from the division Basidiomycota. In some cases, the Basidiomycota fungus or fungal cell can be from the genus *Psilocybe, Conocybe, Gymnopilus, Panaeolus, Pluteus*, or *Stropharia*. In some cases, the fungus or fungal cell is from *Gymnopilus dilepis*. In some cases, the fungus or fungal cell is from *Pluteus salicinus*. In some cases, the fungus or fungal cell is from *Psilocybe cubensis*. In some cases, the fungus or fungal cell is from *Panaeolus cyanescecens*. In some cases, the fungus or fungal cell is from *Pleurotus nebrodensis*. In some cases, the fungal cell is a mycelium, or mycelial cell. In some embodiments, the fungal cell is an aerial mycelium. In some embodiments, the protoplast is isolated from a mycelium, or mycelial mass. In some embodiments, the fungal cell is an aerial mycelium. In some cases, the fungal cell is a fungal protoplast. In some embodiments, a mycelial mass is present and comprises the fungal cells.

In some embodiments, a genetically modified organism described herein is a plant. For example, in some embodiments, the genetically modified organism is from the genus *Cannabis*. In some cases, a genetically modified organism described herein is a bacterium. In some cases, a bacterium is an *agrobacterium*.

In some embodiments, a genetically modified organism described herein comprises *Mitragyna speciosa* (commonly known as kratom). Kratom is a tropical evergreen tree in part of the coffee family, which is native to Southeast Asia. Kratom is indigenous to Thailand, Indonesia, Malaysia, Myanmar, and Papua New Guinea, where it has been used in herbal medicine since at least the nineteenth century. Kratom has opioid properties and some stimulant-like effects. In some embodiments, compositions and methods described herein are used to produce a genetically modified kratom having increased opioid or stimulate-like properties.

In some embodiments, a genetically modified organism can be a eukaryotic organism. In some embodiments, a genetically modified organism described herein can be a fungus. In some embodiments, a genetically modified organism can be of the phylum basidiomycota.

In some embodiments, a genetically modified organism can be a eukaryotic organism. In some embodiments, a genetically modified organism described herein can be a fungus. In some embodiments, a genetically modified organism can be of the phylum basidiomycota. In some embodiments, a genetically modified organism can be from a genera selected from *Copelandia, Gymnopilus, Inocybe, Panaeolus, Pholiotina, Pluteus*, and *Psilocybe*. In some embodiments, a genetically modified organism described herein can be a multicellular organism. In some instances, a genetically modified organism can be a unicellular organism. For example, in certain embodiments, the organism can be a single plant cell or a single fungal cell. Embodiments described herein also include populations of cells, for instance a population of cells from a fungal species. For example, in some embodiments, the genetically modified organism comprises a population of genetically modified fungal cells that collectively form a mycelial mass.

In some embodiments, this disclosure provides genetically modified organisms that are genetically modified, for instance by upregulation of the PsiD gene or introducing an exogenous PsiD gene, to enhance the conversion of L-tryptophan or 4-hydroxy-L-tryptophan to tryptamine. For example, the genetically modified organisms can comprise a genetic modification that results in an increased expression of L-tryptophan decarboxylase as compared to a comparable wild-type organism. In additional embodiments, this disclosure provides genetically modified cells or organisms that comprise a genetic modification that suppresses or minimizes one or more pathways of consumption of either 4-hydroxy-L-tryptophan or tryptophan, thereby enhancing the formation of tryptamine and optionally downstream derivatives of tryptophan-derived alkaloids, such as psilocybin and psilocin. In some cases, this enhancement is achieved by introducing or upregulating genes associated with the expression or activity of tryptophan decarboxylase. Accordingly, the genetically modified organism as described herein can be useful to make an increased amount of a tryptophan-derived alkaloid (e.g., psilocybin) as compared to a comparable wild-type organism.

In some embodiments, this disclosure provides a genetically modified organism that is genetically modified to suppress the conversion of psilocybin to psilocin. For example, in some embodiments this disclosure provides a genetically modified organism that is modified to reduce or eliminate expression of an alkaline phosphatase, e.g., psilocybin phosphatase, which can dephosphorylate psilocybin thereby converting psilocybin into psilocin. By suppressing or eliminating the activity of the alkaline phosphatase, the genetically modified organism can comprise a higher concentration of psilocybin as compared to a comparable wild-type organism, i.e., a comparable organism without the genetic modification. In some embodiments, the additional modulation of PsiR, can influence the production of alkaloid synthesis.

In some embodiments, PsiR is introduced as an exogenous nucleotide. In different species fungal species, the order of the psilocybin producing gene cluster contains discrepancies with respect to its transcriptional regulators (e.g., PsiR). The diversity in composition can suggest that there are alternative routes of psilocybin production, and/or additional biosynthetic pathways capable of producing non-naturally occurring alkaloids beyond the psilocybin scaffold. It is known that some psilocybin producing mushrooms contain a transcriptional regulator, PsiR, though its placement varies, as discussed above. PsiR is a basic Helix-Loop-Helix (bHLH) transcriptional regulator expressed in fruiting bodies. bHLH are known to bind DNA to a consensus hexanucleotide sequence known as the E-box (CANNTG). Other genes in the psilocybin biosynthesis gene cluster which also contain one E-box motif in their promoters are PsiD, PsiH, PsiM, and PsiT2. PsiT1 has two E-box motif regions. Interestingly, PsiP contains 4 E-box motifs (500 base pairs upstream of ATG). PsiL and PsiK do not have this promoter region. When a fungus includes multiple PsiP genes, the genes or their protein expression products referenced herein may be numbered to differentiate, e.g., PsiP1 and PsiP2.

In some embodiments, the genetically modified organism can comprise one or more genetic modifications. In some embodiments, the genetically modified organism can comprise a genetic modification that results in modulation of a psilocybin biosynthesis enzyme. For example, in some embodiments, the genetically modified organism can comprise a genetic modification that results in an increased expression of L-tryptophan decarboxylase as compared to a comparable wild-type organism, and a genetic modification that results in decreased expression or activity of an alkaline phosphatase, e.g., psilocybin phosphatase. In different embodiments, the genetically modified organism can comprise a genetic modification that results in increased expression of L-tryptophan decarboxylase as compared to a comparable wild-type organism, and a genetic modification that results in increase expression of a 4-hydroxytryptamine kinase as compared to a comparable wild-type organism. In some embodiments, the genetically modified organism can comprise a genetic modification, for instance upregulation of the PsiD gene or introduction of an exogenous PsiD gene, that results in increased expression of L-tryptophan decarboxylase as compared to a comparable wild-type organism, a genetic modification that results in increase expression of a 4-hydroxytryptamine kinase as compared to a comparable wild-type organism, and a genetic modification that results in reduced expression of psilocybin phosphatase as compared to a comparable wild-type organism. Additionally, in other embodiments, the genetically modified organism can further comprise a genetic modification that results in increased expression of a methyltransferase, such as the methyltransferase encoded by PsiM. The genetically modified organism can also further comprise a genetic modification that results in increased expression of a P450 monooxygenase as compared to a comparable wild-type organism.

In some embodiments, genetically modified organisms described herein can include one or more genetic modifications that result in any one of (a) increased tryptophan decarboxylation, (b) increased tryptamine 4-hydroxylation, (c) increased 4-hydroxytryptamine O-phosphorylation, (d) increased psilocybin via sequential N-methylations, or (e) reduced expression of a psilocybin phosphatase as compared to a control organism without the genetic modification. The genetically modified organism can further include any one or more of genetically modifications described in WO 2021/067626, which is incorporated by reference in its entirety.

For example, in some embodiments the genetically modified organism includes a genetic modification that results in (i) upregulated expression of a tryptophan decarboxylase gene, a psilocybin-related hydroxylase gene, a psilocybin-related N-methyltransferase gene, or a psilocybin-related phosphotransferase gene; (ii) reduced synthesis of non-psilocybin tryptamines; and/or (iii) increased production of tryptophan in the genetically modified organism compared to a comparable control organism without the genetic modification. Advantageously, as a result of the genetic modification the genetically modified organism can produce an increased amount of a compound, such as, for example, a compound selected from:

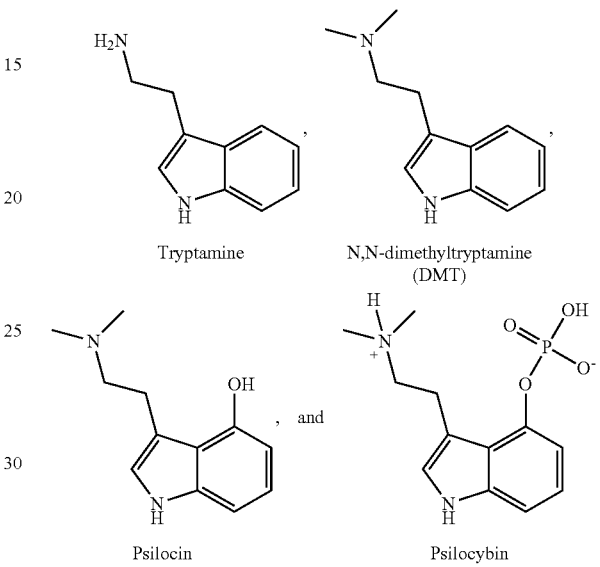

Tryptamine, N,N-dimethyltryptamine (DMT), Psilocin, and Psilocybin as compared to production of the same compound in a comparable control organism without the genetic modification.

In some embodiments, systems, compositions and methods of this disclosure can produce a genetically modified organism includes a genetic modification that results in the genetically modified organism exhibiting a phenotype that is visually distinct from a phenotype of a comparable wild-type organism. For example, in some embodiments, the phenotype comprises a blue coloration. The phenotype can be measured using methods known in the art, for example, the phenotype comprising the blue coloration can be measured using a spectrophotometer. The spectral reflectance, of the genetically modified organism, in the wavelength region from 400 to 525 nm (the blue regions) can be high, and the spectral reflectance for wavelengths longer than 550 nm can be low. Conversely, a comparable wild-type organism can be described as have a spectral reflectance in the wavelength region from 400 to 525 that is substantially lower than the genetically modified organism. In some embodiments, the genetically modified organism is a mycelial mass comprising the blue phenotype. In some embodiments, the genetically modified organism comprises a fungus with the blue phenotype. In some embodiments, a phenotypic distinction can include a change in color of a fungus, or portion thereof, from a color of the fungus, or portion thereof, prior to a genetic change or modification of the fungus, or portion thereof. In some embodiments, a phenotypic distinction can include a change in color, shape, length, mass, thickness, density, or any combination of these, of a fungus, or portion thereof, from a color, shape, length, mass, thickness, density, of the fungus, or portion thereof, prior to a genetic change or modification of the fungus, or portion thereof. In some embodiments, a fungus can include or be a mature fungus, a fruiting body, a mycelial mass, primordial cells, or any combination of these. In other embodiments, a portion of the genetically modified organism comprises the blue phenotype, for example, an inner portion of tissue upon exposure to air. Because of the association between the blue phenotype and increased alkaloid content, in some embodiments, the blue phenotype is used as a reporter of allodial content, e.g., psilocin.

In some embodiments, this disclosure involves the discovery that increased expression of L-tryptophan decarboxylase in a fungus or fungal cell can alter a phenotype of the fungus or fungal cell. In some embodiments, this disclosure involves methods of assessing whether a fungal organism is genetically modified or assessing to what extent a fungal organism expresses an alkaloid such as psilocybin or psilocin based on a blue coloration of the organism.

In some embodiments, the genetically modified organism can include a genetic modification that results in the upregulation or down regulation of a gene product. For example, a gene product encoded by any one of the genes that are described in TABLE 1 or TABLE 2, or that comprise a sequence that is at least, for example, 65%, 75%, 85%, 90%, 95%, 99%, or 100% identical to one of the sequences listed in TABLE 1 or TABLE 2. In some instances, the genetically modified organism includes a genetic modification that results in an increased expression of a gene product, for example, one or more of the gene products identified in TABLE 3. TABLE 1 and TABLE 2 provides a list of exemplary genes that can be upregulated or downregulated in a genetically modified organism described herein. Length and number of introns of psilocybin biosynthetic genes in P. cubensis and P. cyanescens. If there are two values in a cell, the first value refers to the respective gene of P. cubensis, the second to P. cyanescens. Values for P. cyanescens genes for PsiR, PsiT1, and PsiT2 of P. cubensis are predicted using the Augustus algorithm. TABLE 2 provides a list of exemplary genes and gene sequences encoding gene products that can be upregulated or downregulated in genetically modified organisms described herein. TABLE 3 provides a list of exemplary polypeptides that can be upregulated or downregulated in a genetically modified organism described herein. In some embodiments the gene product has a sequence comprising SEQ ID NO: 17-28. In some embodiments the gene product has a sequence of SEQ ID NO: 17-28.

TABLE 1. shows exemplary genes that can be upregulated or downregulated in a genetically modified organism. Length and number of introns of psilocybin biosynthetic genes for P. cubensis and P. cyanescens are shown. If there are two values in a cell, the first value refers to the respective gene of P. cubensis, the second to P. cyanescens. Values for P. cyanescens genes for PsiR, PsiT1, and PsiT2 of P. cubensis are predicted using the Augustus algorithm. An exemplary intron sequence is: gtttgtctctcgcttgcatac-cacccagcagctcactgatgtcgacttgtag (SEQ ID NO.: 450).

TABLE 1

Exemplary genes encoding gene products that can be upregulated or downregulated in genetically modified organisms.

| Gene | Length (bp) | Number of introns | cDNA length | Predicted or verified function of gene product | GenBank accession number |
|---|---|---|---|---|---|
| PsiD | 1426/1441 | 2/2 | 1320/1320 | L-tryptophan decarboxylase | KY984101/ KY984104 |
| PsiH | 2155/2128 | 10/10 | 1527/1527 | Monooxygenase | MF000993/ MF000997 |
| PsiK | 1152/1147 | 1/1 | 1089/1086 | Kinase | KY984099/ KY984102 |
| PsiM | 1587/1580 | 11/11 | 930/930 | N-methyltransferase | KY984100/ KY984103 |
| PsiT2 | 2014/2047 | 8/8 | 1572/1587 | Transporter | MF000992/ MF000996 |
| PsiT1 | 1696/1696 | 5/5 | 1416/1419 | Transporter | MF000991/ MF000995 |
| PsiR | 1556/1619 | 2/2 | 1077/1113 | Transcription factor | MF000990/ MF000994 |

TABLE 2

Exemplary genes and gene sequences encoding gene products that can be upregulated or downregulated in genetically modified organisms described herein.

| Name | SEQ ID NO: | Sequence |
|---|---|---|
| Psilocybe cubensis strain FSU 12409 tryptophan decarboxylase (PsiD) mRNA, complete cds GenBank: KY984101.1 | 1 | atgcaggtgatacccgcgtgcaactcggcagca ataagatcactatgtcctactcccgagtctttt agaaacatgggatggctctctgtcagcgatgcg gtctacagcgagttcataggagagttggctacc cgcgcttccaatcgaaattactccaacgagttc ggcctcatgcaacctatccaggaattcaaggct ttcattgaaagcgacccggtggtgcaccaagaa tttattgacatgttcgagggcattcaggactct ccaaggaattatcaggaactatgtaatatgttc aacgatatctttcgcaaagctcccgtctacgga gaccttggccctcccgtttatatgattatggcc aaattaatgaacacccgagcgggcttctctgca ttcacgagacaaaggttgaaccttcacttcaaa aaacttttcgatacctggggattgttcctgtct tcgaaagattctcgaaatgttcttgtggccgac cagttcgacgacagacattgcggctggttgaac gagcgggccttgtctgctatggttaaacattac aatggacgcgcatttgatgaagtcttcctctgc gataaaaatgccccatactacggcttcaactct tacgacgacttctttaatcgcagatttcgaaac cgagatatcgaccgacctgtagtcggtggagtt aacaacaccaccctcatttctgctgcttgcgaa tcactttcctacaacgtctcttatgacgtccag |

TABLE 2-continued

Exemplary genes and gene sequences encoding gene products that can be upregulated or downregulated in genetically modified organisms described herein.

| Name | SEQ ID NO: | Sequence |
|---|---|---|
| | | tctctcgacactttagttttcaaaggagagact |
| | | tattcgcttaagcatttgctgaataatgaccct |
| | | ttcaccccacaattcgagcatgggagtattcta |
| | | caaggattcttgaacgtcaccgcttaccaccga |
| | | tggcacgcacccgtcaatgggacaatcgtcaaa |
| | | atcatcaacgttccaggtacctactttgcgcaa |
| | | gccccgagcacgattggcgaccctatcccggat |
| | | aacgattacgacccacctccttaccttaagtct |
| | | cttgtctacttctctaatattgccgcaaggcaa |
| | | attatgtttattgaagccgacaacaaggaaatt |
| | | ggcctcattttccttgtgttcatcggcatgacc |
| | | gaaatctcgacatgtgaagccacggtgtccgaa |
| | | ggtcaacacgtcaatcgtggcgatgacttggga |
| | | atgttccatttcggtggttcttcgttcgcgctt |
| | | ggtctgaggaaggattgcagggcagagatcgtt |
| | | gaaaagttcaccgaacccggaacagtgatcaga |
| | | atcaacgaagtcgtcgctgctctaaaggcttag |
| Psilocybe cubensis strain FSU 12409 putative monooxygenase (PsiH) gene, complete cds GenBank: MF000993.1 | 2 | atgatcgctg tactattctc cttcgtcatt gcaggatgca tatactacat cgtttctcgt agagtgaggc ggtcgcgctt gccaccaggg ccgcctggca ttcctattcc cttcattggg aacatgtttg atatgcctga agaatctcca tggttaacat ttctacaatg gggacgggatta cagtctgt cttgccgcgt tgacttctaa tatatgaaca gctaatatat tgtcagacac cgatattctc tacgtggatg ctggagggac agaaatggtt attcttaaca cgttggagac cattaccgat ctattagaaa agcgagggtc catttattct ggccggtgag ctgatgttga gttttttgca attgaatttg tggtcacacg tttccagact tgagagtaca atggtcaacg aacttatggg gtgggagttt gacttagggt tcatcacata cggcgacagg tggcgcgaag aaaggcgcat gttcgccaag gagttcagtg agaagggcat caagcaattt cgccatgctc aagtgaaagc tgcccatcag cttgtccaac agcttaccaa aacgccagac cgctgggcac aacatattcg ccagtaagta ctacttgagg aaaatagcgt acgcttcgct gaccggtccg tacatcaaag tcagatagcg gcaatgtcac tggatattgg ttatggaatt gatcttgcag aagacgaccc ttggctggaa gcgacccatt tggctaatga aggcctcgcc atagcatcag tgccgggcaa attttgggtc gattcgttcc cttctcgtga gcatccttct tctatgtagg aagggaagga gtctaacaag tgttagtaaa ataccttcct gcttggttcc caggtgctgt cttcaagcgc aaagcgaagg tctggcgaga agccgccgac catatggttg acatgcctta tgaaactatg aggaaattag cagttagtca aatgcgttct ccccgtattt tttcaatact ctaacttcag ctcacagcct caaggattga ctcgtccgtc gtatgcttca gctcgtctgc aagccatgga tctcaacggt gaccttgagc atcaagaaca cgtaatcaag aacacagccg cagaggttaa tgtcggtaag tcaaaagcgt ccgtcggcaa ttcaaaattc aggcgctaaa gtgggtcttc tcaccaaggt ggaggcgata ctgtaaggat ttctcaatcg ttagagtata agtgttctaa tgcagtacat actccaccaa ccagactgtc tctgctatgt ctgcgttcat cttggccatg gtgaagtacc ctgaggtcca gcgaaaggtt caagcggagc ttgatgctct gaccaataac ggccaaattc ctgactatga cgaagaagat gactccttgc catacctcac cgcatgtatc aaggagcttt tccggtggaa tcaaatcgca cccctcgcta taccgcacaa attaatgaag gacgacgtgt accgcgggta tctgattccc aagaacactc tagtcttcgc aaacacctgg tgaggctgtc cattcattcc tagtacatcc gttgccccac taatagcatc ttgataacag ggcagtatta aacgatccag aagtctatcc agatccctct |

TABLE 2-continued

Exemplary genes and gene sequences encoding gene products that can be upregulated or downregulated in genetically modified organisms described herein.

| Name | SEQ ID NO: | Sequence |
|---|---|---|
| | | gtgttccgcc cagaaagata tcttggtcct<br>gacgggaagc ctgataacac tgtacgcgac<br>ccacgtaaag cggcatttgg ctatgacga<br>cgaaattggt aagtgcgctt tcagaacccc<br>cccttccgtt gactagtgcc atgcgcgcat<br>acaatatcgc tattgatctg atataacttc<br>cctgcggcat ttattttggc attcctttag<br>tcccggaatt catctagcgc agtcgacggt<br>ttggattgca ggggcaaccc tcttatcagc<br>gttcaatatc gagcgacctg tcgatcagaa<br>tgggaagccc attgacatac cggctgattt<br>tactacagga ttcttcaggt agctaatttc<br>cgtctttgtg tgcataatac ccctaacgac<br>gcacgtttac cttttgtaa agacacccag<br>tgcctttcca gtgcaggttt gttcctcgaa<br>cagagcaagt ctcacagtcg gtatccggac<br>cctga |
| Psilocybe cubensis strain FSU 12409 4-hydroxytryptamine kinase (PsiK) mRNA, complete cds GenBank: KY984099.1 | 3 | atggcgttcg atctcaagac tgaagacggc<br>ctcatcacat atctcactaa acatctttct<br>ttggacgtcg acacgagcgg agtgaagcgc<br>cttagcggag gctttgtcaa tgtaacctgg<br>cgcattaagc tcaatgctcc ttatcaaggt<br>catacgagca tcatcctgaa gcatgctcag<br>ccgcacatgt ctacggatga ggattttaag<br>ataggtgtag aacgttcggt ttacgaatac<br>caggctatca agctcatgat ggccaatcgg<br>gaggttctgg gaggcgtgga tggcatagtt<br>tctgtgccag aaggcctgaa ctacgactta<br>gagaataatg cattgatcat gcaagatgtc<br>gggaagatga agacccttt agattatgtc<br>accgccaaac cgccacttgc gacggatata<br>gcccgccttg ttgggacaga aattggggg<br>ttcgttgcca gactccataa cataggccgc<br>gagaggcgag acgatcctga gttcaaattc<br>ttctctggaa atattgtcgg aaggacgact<br>tcagaccagc tgtatcaaac catcataccc<br>aacgcagcga aatatggcgt cgatgacccc<br>ttgctgccta ctgtggttaa ggaccttgtg<br>gacgatgtca tgcacagcga agagacccctt<br>gtcatggcgg acctgtggag tggaaatatt<br>cttctccagt tggaggaggg aaacccatcg<br>aagctgcaga agatatatat cctggattgg<br>gaactttgca agtacggccc agcgtcgttg<br>gacctgggct atttcttggg tgactgctat<br>ttgatatccc gctttcaaga cgagcaggtc<br>ggtacgacga tgcggcaagc ctacttgcaa<br>agctatgcgc gtacgagcaa gcattcgatc<br>aactacgcca aagtcactgc aggtattgct<br>gctcatattg tgatgtggac cgactttatg<br>cagtggggga gcgaggaaga aaggataaat<br>tttgtgaaaa agggggtagc tgcctttcac<br>gacgccaggg gcaacaacga caatggggaa<br>attacgtcta ccttactgaa ggaatcatcc<br>actgcgtaa |
| Psilocybe cubensis strain FSU 12409 norbaeocystin methyltransferase (PsiM) mRNA, complete cds GenBank: KY984100.1 | 4 | atgcatatca gaaatcctta ccgtacacca<br>attgactatc aagcactttc agaggccttc<br>cctcccctca agccatttgt gtctgtcaat<br>gcagatggta ccagtctgt tgacctcact<br>atcccagaag cccagagggc gttcacggcc<br>gctcttcttc atcgtgactt cgggctcacc<br>atgaccatac agaagaccg tctgtgccca<br>acagtcccca ataggttgaa ctacgttctg<br>tggattgaag atatttcaa ctacacgaac<br>aaaaccctcg gcctgtcgga tgaccgtcct<br>attaaaggcg ttgatattgg tacaggagcc<br>tccgcaattt atcctatgct tgcctgtgct<br>cggttcaagg catggtctat ggttggaaca<br>gaggtcgaga ggaagtgcat tgacacggcc<br>cgcctcaatg tcgtcgcgaa caatctccaa<br>gaccgtctct cgatattaga gacatccatt<br>gatggtccta ttctcgtccc cattttcgag<br>gcgactgaag aatacgaata cgagtttact |

TABLE 2-continued

Exemplary genes and gene sequences encoding gene products that can be upregulated or downregulated in genetically modified organisms described herein.

| Name | SEQ ID NO: | Sequence |
|---|---|---|
| | | atgtgtaacc ctccattcta cgacggtgct gccgatatgc agacttcgga tgctgccaaa ggatttggat ttggcgtggg cgctccccat tctggaacag tcatcgaaat gtcgactgag ggaggtgaat cggctttcgt cgctcagatg gtccgtgaga gcttgaagct tcgaacacga tgcagatggt acacgagtaa cttgggaaag ctgaaatcct tgaaagaaat agtggggctg ctgaaagaac ttgagataag caactatgcc attaacgaat acgttcaggg gtccacacgt cgttatgccg ttgcgtggtc tttcactgat attcaactgc ctgaggagct ttctcgtccc tctaaccccg agctcagctc tcttttctag |
| *Psilocybe cubensis* strain FSU 12409 putative transporter (PsiT2) gene, complete cds GenBank: MF000992.1 | 5 | atgtctctggagcgctcaacaagtccaaatcct accgagcgtacatctcttctatctgacactgcg tctaccatttcatccagagatgacgttgaacag tcaagtctgaagcaaaggcgcacgcctatacca actggacaacttggcggtaaggtctcaatgcat tcaattattataaacgctgagggtcatttatgg cctatattaaccagtttgtgaatgatatcggc gtctctgatgggaatccacgtaatgttgggttc tacagtgggttgatcgaaagtgtatttgcttgc ggagaagtttgctctatcttcatgctgtcgagg cttttcagatagaataggtcgtcgaccggtgcta ctcccatctgcactgggtattgcagtgtttact gctctgtttggtttatcaagctcgtttaccatg atgttgactcttcgagtttgcgctggtctctta gccggagcgacgcctatagtacactccattgtc agcgaacttactgatgataccaataatgcactc gttgtaccattatatggcctcataactcccatc ggatttgccattgggcccctgatcggggaacc cttgaacacgctgcaactaagtatcccaacgtc tttggatatgagcttttcgaaagtaccccctac ttcttaccatcgtttgttccatgctgcatggct atcgtgggcgtcacattcggctacttcttttta aaagaaacgcttcctagtttagtcaagtctaaa aaaagacttgaacgtcaacggtcctcctcttct atatcatcagagaactctactctatacggtgcc acagagcatatcagggactcaacagaagaaacc gcggcggacgaggaacccgattccaagccgaag ggtattactgagttaattcgggatccttctata cgggctataatggcttctggtacatttttgatg tttctatacacgagttccgatgtgatattctca ctctactgctttactgctgttgaggatggaggc gttggattgcctcccgagaagatcggttatgca ttctccgttgcaggcctcatagctatgctcatg cagctttgcataacgccatgggtgctccgtact tttgacaaggctaaagtataccacttctgcatg tgctcgttccctctcgtgtttgcactcatggga tgcctgaatcccctcgctcaaactgggtacagt gaaattaacaaaacacttcatccgaccactacg ggactgctctatgctgcaatagccatcttgctc cttctagcccgtgtctgcgttatggcattccct atcagcatgatgctggttaaacaaacggccgat aagcattcgcttgccactgcgaatggcctcgtg caagtggccatgacccttgcaagagcattctgc cctacaatctcaagctcggtgtttgcttattct actagccataatatcctgggtggacatttctgg gtggtagtgatggtattcatttccctggttggg gtatggcaatctacgaaaattgccagggtcaca aaaacaaaagagcaattgtga |
| *Psilocybe cubensis* strain FSU 12409 putative transporter (PsiT1) gene, complete cds GenBank: MF000991.1 | 6 | atgaatcctacgaccgccaccgatgctcatgaa cgaacatcgctgttgtctgaagaccgcaatct gctgcaaattcgacggctccatatgagcgacaa gttcaaccatcgcgaaaatcccaatgctttact ccagtgaccgtgatcaccataattacgctcata tatcgtctcgcgacaacgatggtaatcacgacc aacattcgggttctccacacagttgcatgccag ctttggtatcatgtcaacgatcccgacgtattt ccaggggaaatataccagaaaaatattgtgcg ctacctggtgtagacaagtattatgctataatg gtgtctatgaccactgtcatagatggtcttgga |

TABLE 2-continued

Exemplary genes and gene sequences encoding gene products that can be upregulated or downregulated in genetically modified organisms described herein.

| Name | SEQ ID NO: | Sequence |
|---|---|---|
| | | ggtatacttgggaccggcatagccagctacatg<br>tcatctcgttttggcagaaagcctgttctcatg<br>ttcctgctttcctgtaccatgatcgatcacctc<br>gccatcctgacagtccaaaatgtatacggatgg<br>aagcagttggtaacatttgggttaattatgatt<br>gttgaaaccattggaaatgagaacaccacagta<br>tttctggtgagcatgtacgtggttgatgttact<br>gaggctgagagaaggaccgctgctctgagttca<br>attactggctggcttgttctcggaggcgccctc<br>gcctattcaataggcggatctataacaacttttt<br>ttacactccaactctgccgtatacattgtatcg<br>ttcagtgtcactggcatcgttctaacattcacc<br>gcctttgttctccctgaatcattccctgctgaa<br>aaaagagatctcttgcggcttgaacgactggca<br>gaaacccgtggacacagccagtcctggacccaa<br>aaaatcaaagctgtggcaactgtcgcattggaa<br>cctatggaattgctaaaaccgacatttaacccc<br>ataacggggaaggcaaattggcggcttgtatac<br>tgcgccctccactcgtttattgtcactctagca<br>gatgcgtatgctcttcctgccatgttgatattt<br>ttcactacccagtattcatatacacccgctcag<br>atgggatatgttatgacgacgtacagtgtctcc<br>agtgtgtttgttttggcgatagccttaccctg<br>tttattcgatggttcaagcccctgtataataat<br>actcaaacgaagtctgtcccagatgaagggat<br>ggactccgtgcgaccgactctggagaagcgggt<br>gtgcacacaagaggtcgttgtttcggaaacc<br>tctgatcgcatggacgtccatatcactgtcata<br>tcctggaccatagagtcattagcatacatagtt<br>ctcggtactgtgggttcattttacgcacaactt<br>ttaggtcggccgttgcctctattggctttggat<br>ctggacgcattccaggaattcgaagcctag |
| *Psilocybe cubensis* strain FSU 12409 putative transcriptional regulator (PsiR) gene, complete cds GenBank: MF000990.1 | 7 | atggcacccgcaacacccgcaactcacgatcct<br>gccttgtcccacggagcccctcctgctccaggt<br>gctccagctcctgcaaatgctcctccaaacgcc<br>tcaggagacattgctggaatgcagctcagcgga<br>ctcgatcagtcccagatcatgaaccttcttcgt<br>tcattgcctggcatgttctcgggcggtaaaata<br>cccgaccaaggccaaggcaacaaagaggatgct<br>gctcaaacgctgtccaaccttgcccaagctcaa<br>ccgtatggacaacaattacccccttcactaccaa<br>gctggcggcccaggaggtctgccaggaattaac<br>gacccaggcccgtccacacatccccgcggccct<br>cccaaccttggccaactgagtgctgtggcaatg<br>caagccgccccgctccaattcagcatccagac<br>cagcaaacgaaccgcaacgatggcgagcaggct<br>ggcaatgcgagtgcaagtacctccggaaaggat<br>ggtgacaatgcagaattcgttcccccacctgct<br>cctgctcctacaactggtcgccgtggtggacgc<br>agcgccaccatgggaagtgacgaatggagcaga<br>cagaggaaggataatcataaagaggttgagcgt<br>cgacgccgcggcaatatcaacgagggcatcaac<br>gagcttggccgcattgtacccagtgggtctggc<br>gagaaggccaaggcgccatcctttctcgagct<br>gtgcagtacatccatcatttgaaagagaacgaa<br>gctcgcaatatcgagaagtggaccccttgagaag<br>cttctcatggaccaggccatgggtgacctgcag<br>gcgcaactcgaagaggtcaagcgtctgtgggaa<br>gaagagcgtatggcgcgcacaagactcgaggcc<br>gagctcgaagtgttgagaaatatgaacggcgtg<br>aatgctggctcggccccggcctcgaaagatgag<br>agtgctgcaggtactaagaggaggagtaccgat<br>ggagcagaggccgccaccgccgccactgaaagc<br>agcaccgccaatgccgagggcgaacgcgacggc<br>aagcgacaaagaaccgagtga |
| *Psilocybe cyanescens* strain FSU 12416 tryptophan decarboxylase (PsiD) mRNA, complete cds GenBank: KY984104.1 | 8 | atgcaggtactgcccgcgtgccaatcttccgcg<br>cttaaaacattgtgcccatccccccgaggcctt<br>cgaaagctcggttggctccctactagcgacgag<br>gtttacaacgaattcatcgatgacttgaccggt<br>cgcacgtgcaatgaaaagtactccagccaggtt<br>acacttttgaagcctatccaagatttcaagaca<br>ttcatcgagaatgatcccatagtgtatcaagaa |

TABLE 2-continued

Exemplary genes and gene sequences encoding gene products that can be upregulated or downregulated in genetically modified organisms described herein.

| Name | SEQ ID NO: | Sequence |
|---|---|---|
| | | tttatctctatgtttgaaggaatcgagcagtct cccaccaactaccacgagctatgtaacatgttc aacgacatctttcgcaaagccccactctacggc gatcttggtcctccggtttacatgatcatggcc agaataatgaatacgcaggcgggtttctctgcg ttcacaaaagagagcttgaacttccatttcaaa aagctcttcgacacctggggctattcctttcc tcgaaaaactctcgaaacgtgcttgttgcagac cagtttgacgataagcattacgggtggttcagc gagcgagccaagactgccatgatgattaattat ccagggcgtacattcgagaaagtcttcatctgc gacgagcacgttccataccatggcttcacttcc tatgacgatttcttcaatcgcaggttcagggac aaggatacagatcggcccgtagtcggtggggtt actgacaccactttaatcggggctgcctgtgaa tcgttgtcatataacgtctctcacaacgtccag tctcttgacacgctagtcatcaagggagaggcc tattcacttaaacatctacttcataacgacccc ttcacaccgcaattcgaacatgggagcatcatt caaggattcctaaatgtcaccgcttaccaccgc tggcactcccccgtcaatggcacgattgtgaag atcgtcaacgttccaggtacctacttcgctcaa gctccatatacaattggatctcctatccccgat aacgaccgcgacccgcctccttacctcaagtca ctcgtatacttctccaacatcgctgcacggcaa attatgttcatcgaggccgacaacaaagacatc ggcctcatttttcttggtcttcattggaatgact gagatctcgacttgcgaggcgacggtgtgcgaa ggtcagcatgtcaaccgcggtgacgatttgggc atgttccatttcggtggttcatcttttgccctt ggcttgcggaaggactcgaaggcgaagattttg gaaaagttcgcgaaaccggggaccgttattagg atcaacgagctagttgcatctgtaaggaagtag |
| Psilocybe cyanescens strain FSU 12416 putative monooxygenase (PsiH) gene, partial cds GenBank: MF000997.1 | 9 | atgattgttctattggtctcgctcgtccttgca ggatgcatatactacgccaacgctcgtagagta aggcgctcgcgcttaccaccgggcccgcctggc ataccactgcccttcattgggaatatgtttgat atgccttcagagtcaccgtggttaagatttctt caatggggacgggactatcacactgatatcctt tacttgaatgctggcggaacggaaataattatt ctgaacacactggatgctataaccgacttgttg gaaaagcgagggtcgatgtattcgggtcgactc gagagcaccatggtgaacgaactcatggggtgg gagttcgacttgggattcataacctatggtgaa agatggcgcgaagaaagacgcatgttcgccaag gagttcagcgaaaaaacatcaggcaattccgc cacgcccaaattaaagctgccaatcagcttgtt cggcagctgatcaaaacgccagatcgttggtcg cagcacatccggcatcagatagcagccatgtct ctagacattggttatggaattgatctcgcagag gatgacccctggattgcagcaacccagctagct aacgaagggctcgccgaagcttcagtaccgggc agtttctgggtcgactcattccccgccctcaaa taccttccttcatggcttcctggtgcaggattc aagcgcaaagcaaaggtatggaaggaaggtgct gaccatatggtgaacatgccgtatgaaacgatg aaaaaattgactgttcaaggcttggcccgacct tcatatgcctcagctcgtctgcaggccatggac cccgatggcgatctcgagcatcaggaacacgtg atcagaaacacagcgactgaggtcaatgtcggc ggaggtgatacgactgtttctgctgtgtcagcc tttattttggccatggtcaaatatccagaagtt caacgccaagtccaagcagaactggatgcactc accagcaaaggagttgtcccaaactatgacgaa gaagacgactccttgccataccttacggcttgc gtcaaggaaatctttcgatggaaccaaatagca ccccttgctatccctcatcggctgatcaaagac gatgtttatcgtgggtatctcataccaaagaat gctttggtctacgccaactcatgggctgtgttg aatgacccagaggagtacccaaatccctctgag ttccgaccagaacgatatttgagctctgacgga aagcccgacccaacggtccgtgatccccgcaaa gcagcatttggctatggtcgacgcaactgtccc |

TABLE 2-continued

Exemplary genes and gene sequences encoding gene products that can be upregulated or downregulated in genetically modified organisms described herein.

| Name | SEQ ID NO: | Sequence |
|---|---|---|
| | | ggaatccacctggcacaatcgacggtatggatt gctggagccactcttctctcggtattcaatatc gaacgtcctgttgatgggaatggaaaacccatc gacatcccggcgacgttcactaccggattcttc agacatcccgagccttccagtgcagatttgtc cctcgcactcaggagattctaaaatccgtttcc ggt |
| Psilocybe cyanescens strain FSU 12416 4-hydroxytryptamine kinase (PsiK) mRNA, complete cds GenBank: KY984102.1 | 10 | atgactttcgatctcaagactgaagaaggcctg ctctcatacctcacaaagcacctatcgctggac gttgctcccaacggggtgaaacgtcttagtgga ggcttcgtcaacgttacctggcgggtcgggctc aatgcccttatcatggtcacacgagcattatt ctgaagcatgctcaaccgcacctgtcttcagac atagatttcaagataggtgttgaacgatcggcg tacgagtatcaagcgctcaaaatcgtgtcagcc aatagctcccttctaggcagcagcgatattcgg gtctctgtaccagaaggtcttcactacgacgtc gttaataacgcattgatcatgcaagatgtcggg acaatgaagaccctgttggactatgtcactgcc aaaccaccaatttctgcagagatcgccagtctc gtaggcagtcaaattggtgcatttatcgctagg ctgcacaacctcggccgcgagaataaagacaag gacgacttcaagttcttctctggaaacatcgtc gggagaacaaccgcagaccagttgtatcaaacc atcatacctaatgccgctaaatacggtatcgac gatccaattctcccaattgtggtaaaggagttg gtggaggaggtcatgaatagtgaagaaacgctt atcatggcggatttatggagtggcaatattctt ctccagtttgatgaaaactcgacggaattgacg aggatatggctggtagactgggagttgtgcaaa tatggtccaccgtctttggacatgggggtacttc ttaggcgactgtttcctggtcgctcgatttcaa gatcagctcgtagggacatcaatgcgacaggcc tacttgaagagctacgcaaggaatgtcaaggag ccaatcaattatgcaaaagccaccgcaggcatc ggcgcgcatctcgtcatgtggactgatttcatg aagtgggggaacgatgaagagagggaagagttt gttaagaaaggcgtggaagccttccatgaagca aatgaggacaatagaaacggggagattacgtct atacttgtgaaggaagcatcgcgcacttag |
| Psilocybe cyanescens strain FSU 12416 norbaeocystin methyltransferase (PsiM) mRNA, complete cds GenBank: KY984103.1 | 11 | atgcatatcaggaacccataccgcgatggtgtt gactaccaagcactcgctgaagcatttccggct ctcaaaccacatgtcacagtaaattcagacaat acgacctccatcgactttgctgtgccagaagcc caaagactgtatacagctgcccttctacaccgg gatttcggtcttacgatcacactcccggaagac cgtctttgtccgacagtgcctaatcggctcaac tatgtcctttgggttgaagatatccttaaagtc acttctgatgctctcggtcttccggataatcgt caagttaaggggatcgatatcggaactggcgca tcagcgatatatcccatgctcgcatgctctcgt tttaagacatggtccatggttgcaacagaggta gaccagaagtgtattgacactgctcgtctcaac gtcattgccaacaacctccaagaacgtctcgca attatagccacctccgtcgatggtcctatactt gtcccctcttgcaggcgaattctgattttgag tacgattttacgatgtgtaatccgcccttctac gatgggcatccgacatgcagacatcggatgct gcgaaggggtttggattcggtgtgaacgctccg cataccggcacggtgctcgagatggccaccgag ggaggtgaatcggcttcgtagcccaaatggtc cgcgaaagtttgaatcttcaaacacgatgcagg tggttcacgagtaatttggggaaattgaagtcc ttgtacgaaattgtggggctgctgcgagaacat cagataagtaactacgcaatcaacgaatacgtc caaggagccactcgtcgatatgcgattgcatgg tcgttcatcgatgttcgactgcctgatcatttg tcccgtccatctaaccccgacctaagctctctt ttctag |
| Psilocybe cyanescens strain FSU 12416 | 12 | atgtcgccagagcgctcagcaagtcttgaacca gatgagcattcgtctctgctctccgatacggcc |

TABLE 2-continued

Exemplary genes and gene sequences encoding gene products that can be upregulated or downregulated in genetically modified organisms described herein.

| Name | SEQ ID NO: | Sequence |
|---|---|---|
| putative transporter (PsiT2) gene, complete cds GenBank: MF000996.1 | | tcctacatctcgagagatgacttagaagactca aaagcgaagcaaatcccgacgcctataccaaag aaacaacttggagttttattttccatcagattc acagaacctataatttacagtcatttgtggcct tatatcaaccaattcgttaatgatatcggggtc gccgacgggaaccctcgctatgttggattttac agtggtttgatcgaaagtgtatttgcttgtgga gaagtgtgttctatcttcatgttatcgaggctg tcagacagaataggtcgccgaccagtgttgctc ccgtctgccctcggcgtagcattatttacagct ttgttcggtttatcgacctcgtttactatgatg ctcgttctccgggtttgtgctggtcttttggcc ggggctactcctatagtccattctgttgtgagt gagctcacggacgaaacgaataatgccctcgta gtaccccttttacgggttaattacacctattggc tttgcgattggacctctgattggtggaactctt gagcacgctgctactaaatatcccaacgtattt ggttatgacttccttcgaaaatatccatacttt ctaccatcctttgttccatgctgcctagctgtc gttggcgtcaccttcggctatttcttcttgcaa gagacgcttcccagtatagtacgggccaagaaa agacttgaacgacagaaatctacttcgtctatt tcgtcaagaacctccaccctatacggtgctaca gatgatcacaatagagatgcatcagaatcaacc gcgttgtctccggaggaagcggaagatgaaatt gactctaagcctcaaagcatcaaagctttaatc gtagaccttctatgcgggccatcatgggttct ggtaccttttctgatgttcctctacacgagttcc gatgttctgttctcactctactgctttactgct gtcgaggacggaggcgtcggattacctcccgac gaaatcggttacgcattctctgttgccggcgtg atagctatgcttatgcagctttgcataacacct tgggtcctacgtacattcgataaggcaaaagta tacaagttctgcatgttctcattcccgcttgta tttgccctcatgggatgtcttaatcccctcgct caaaccgggtataatgaagtctctaagactatc caccctaccacaacgggacttctttacgctgct attgctgtgttgctactgttggcacgggtctgc gtcatggcgttcccgatcagcatgatgttgatt aagcagaatgccgataaaaactcactcgccact gcgaacgggcttgtgcaagtgtcgatgaccatt gctagagcactctgccccacggtctctagttcg ctcttcgcttattccacgagcaacaatattctg ggtggtcatctctgggtccttattatggtgacc atatccctcgcaggcgtctggcagtcgatgagc atcgcccgcgttaccaaaagaaaggaagagcta taa |
| Psilocybe cyanescens strain FSU 12416 putative transporter (PsiT1) gene, complete cds GenBank: MF000995.1 | 13 | atgaatcctacgaccgccaccgatgctcatgaa cgaacatcgctgttgtctggaagaccgcaatct gctgcaaattcgacggctccatatgagcgacaa gttcaaccatcgcgaaaatcccaatgctttact ccagtgaccgtgatcaccataattacgctcata tatcgtctcgcgacaacgatggtaatcacgacc aacattcgggttctccacacagttgcatgccag ctttggtatcatgtcaacgatcccgacgtattt ccaggggaaatataccagaaaaatattgtgcg ctacctggtgtagacaagtattatgctataatg gtgtctatgaccactgtcatagatggtcttgga ggtatacttgggaccggcatagccagctacatg tcatctcgttttggcagaaagcctgttctcatg ttcctgctttcctgtaccatgatcgatcacctc gccatcctgacagtccaaaatgtatacggatgg aagcagttggtaacatttgggttaattatgatt gttgaaaccattggaaatgagaacaccacagta tttctggtgagcatgtacgtggttgatgttact gaggctgagagaaggaccgctgctcgagttcaa ttactggctggcttgttctcggaggcgccctcg cctattcaataggcggatctataacaactttt tacactccaactctgccgtatacattgtatcgt tcagtgtcactggcatcgttctaacattcaccg cctttgttctccctgaatcattccctgctgaaa aaagagatctcttgcggcttgaacgactggcag aaacccgtggacacagccagtcctggacccaaa |

TABLE 2-continued

Exemplary genes and gene sequences encoding gene products that can be upregulated or downregulated in genetically modified organisms described herein.

| Name | SEQ ID NO: | Sequence |
|---|---|---|
| | | aaatcaaagctgtggcaactgtcgcattggaac<br>ctatggaattgctaaaaccgacatttaacccca<br>taacggggaaggcaaattggcggcttgtatact<br>gcgccctccactcgtttattgtcactctagcag<br>atgcgtatgctcttcctgccatgttgatatttt<br>tcactacccagtattcatatacacccgctcaga<br>tgggatatgttatgacgacgtacagtgtctcca<br>gtgtgtttgttttggcgatagccttacccctgt<br>ttattcgatggttcaagcccctgtataataata<br>ctcaaacgaagtctgtcccagatgaaggggatg<br>gactccgtgcgaccgactctggagaagcgggtg<br>tgcacacacaagaggtcgttgtttcggaaacct<br>ctgatcgcatggacgtccatatcactgtcatat<br>cctggaccatagagtcattagcatacatagttc<br>tcggtactgtgggttcattttacgcacaacttt<br>taggtcggccgttgcctctattggctttggatc<br>tggacgcattccaggaattcgaagcctag |
| Psilocybe cyanescens strain FSU 12416 putative transcriptional regulator (PsiR) gene, complete cds GenBank: MF000994.1 | 14 | atggcacccacaacacccgcaactcacgatcca<br>gccttgtcccacggagctcctcctactcagggc<br>tcgcaggcaccagcaaatgcggccccaaatctt<br>accccagccgacatctctggcatgcaactcaac<br>ggcctcgatcagtcccagatcatgaaccttctc<br>cgttcattgcccggcatgttcacaggtgctaaa<br>ataccagatcaaggacaaggcaatcccaaagag<br>gatgctgcccaaacactgtccaacctcgcacag<br>gcttcatcacccttcggcggccaacatttgccc<br>atccactatcaaaccggcgctgctggtggtctt<br>ccaggaatcaacgacccaggcccgtcaactcac<br>ccccgcggccctcctaacctcggccagctgagt<br>gctgtcgcgatgcaagcggccccagcgacgatc<br>caacaccaggaccagcaacagtctgggcgccag<br>gaagacggcgagcggccggaaatacgagcattg<br>atagcccatctgcgaaagatggcgagaatggca<br>ctggggagtttaaccagacgtctacgagcactc<br>cttcgggaggccgtcgggggggcgcagtgccac<br>catgggcagcgacgaatggagcaggcagaggaa<br>ggataatcataaagaggttgagcgtcggcgccg<br>cggaaatatcaacgaagggattaacgagctggg<br>ccgcatcgtaccgagcggatcaggcgagaaagc<br>caaaggcgccatcctctcgcgcgccgtgcagta<br>catccaccatttgaaagagaatgaagctcggaa<br>catcgagaagtggacgcttgagaagctacttat<br>ggatcaggcgatgggcgacctgcaggcgcaact<br>tgaggagatcaagcggctgtgggaggaggagcg<br>catggctcgtacgaggcttgaggctgagctcga<br>ggtgttgaggaatatgaatggtgtgagtactgc<br>cggtgcgggttcgggtgcggcgaaggatgaaag<br>cgctgccggcacgaagcggaggagcacggatgg<br>tgctgatgctgccggcacaaatgttgaaggtgg<br>taataacgacaacgctgaaggagagagggacgg<br>aaaacgtcagagaactgagtga |
| Psilocybe cubensis, Strain: MGC-MH-2018 (PsiP1) GenBank: JAFIQS010000002.1 | 15 | ATGCACAGTCTCGGTCTGTTCGCTTTAATCAGC<br>TTGTTGCCCTACCTCGTCGTCGCGCAACGTGCA<br>TCGACCTTTGCAGGCGCGACTACAACCGCTGTG<br>TTCCCCCCACCCAATGCTGGTATTGCAGCAACC<br>GACACGAACTTCCCCGATGGCTCTAAAGTTGGA<br>TTCCCAGGTCCAACGCGCAGTACGTCTCTTGAA<br>CTTTTGCTGGAGGTGTAAAGCTCAACGATATTT<br>TGTAGCCGGAGACGAAGCAGCAGCAATAGAGAC<br>TGCACCTGTGGCTGCCAAAGTCGACAGCTTCTT<br>CCCCCTGATCAATGGGGGTGCTGAAGATAGCAC<br>ACCGATGGACCCCTTCGACGTCTTGGTGCACCT<br>CGGAAATTTGAGCCCTTTCCAATCCGTCCCATC<br>ATCGGCGTTTGGTCTGCCTGGAGCATCTCCTCT<br>CATTCCTGAGGGATGCGACATCGTACAGGCCCA<br>CCTTCTTCACCGCCATGGTGCGCGTTACCCCAC<br>TGCTGACAGTGGTCCCCCAGGATTTGCAGCCAA<br>GGTCAATGCCGCTGCTAATTCGGGATCTGGGTT<br>CTCGGCGAAAGGCGATCTCAGTTTCTTGAACAC<br>TTGGACTTACAAACTCGGTGGTGACATTTTGAC<br>ACCTTTTGGTGCTCACAACTGTACGCTCCTAT<br>CAGTTTATGGCTTGAAGCGTCGCTCATACTTTT |

TABLE 2-continued

Exemplary genes and gene sequences encoding gene products that can be upregulated or downregulated in genetically modified organisms described herein.

| Name | SEQ ID NO: | Sequence |
|---|---|---|
| | | CACCAGCTTCAACTTGGGTGTTGGGTTCCGTGT<br>CAAATATGGTATGAATATTGCTTCAGCATTCTA<br>ATCTCTCCTACTAATTAAATGTTAGGCCAATTG<br>CTGAAAGGATTCAAGAATCTACCCGTCTTCCGA<br>ACAACCTCCGAAGGTAAATCGCGAGTCTATACC<br>TCTATCATCAACTAGACTAATGTAAATCTTAGC<br>GCGTATGCTTGACTCCGCGTTCGTAAATCTTTG<br>ACAGAAACTGTCAAAATTTAGCTGACTCTCTTT<br>TCAATAGTCTCCACTTCGCTACGGGTTTCTTCG<br>GTGTACAAAAGTACCAAGATAGTTATCACCAAC<br>TTATCACGATTGAACACGGGGGAAAGCAGAACA<br>ACACCCTTGCCCCTTACGAGTCTTGCACTAACG<br>GACTGAATGATGTCGCCGCGTTCGGTGACATTC<br>AAAGCCAGAAATGGGCCCAGATCTACTTGGCCC<br>CTGCAGTAAAGAGGCTGAACGCAAACCTCAGGG<br>GACTGCAACTCAACGTGACGGACTTGTTTGCTA<br>TGCAACAACTCTGCGCTTTCGAGGTACATATTT<br>CCCTCTCCTCATGTTCATAATATTAATGTTACG<br>TCAAAAGACCGTCGCCCTTGGATATTCCTCTTT<br>CTGCGACCTGTTCACTGAGGAGGAATGGAGAGG<br>ATTCGAATATCAAAGCGGTAATACAAAATATAT<br>TTTTGCCTTTGTACCTCTTGTGACCTGACTGGA<br>CCTAGATCTTCAATTCTGGTACTCTTTCGGACC<br>CGGTAACCCCGCATCCAGCGCCATGGGTATCGG<br>CTACGTCCAGGAACTCGTTTCACGACTCACCAA<br>GACGCGCATCACGACCTTCGACACCACAGTCAA<br>CGCCTCGATTGTGACGAGCGATATTCTCTTCCC<br>ACTAGACCAACCTATTTACGTTGACGCAACCCA<br>CGACACGATTCTGACGGCTAGTGAGTGTTGTAT<br>ATCTGTTATGATTCACGTGTCCTGACACCTTGC<br>CAGTTTTCGCTGCCATGAACCTTACGACTCTTG<br>CTGCCAACGGACCTCTGCCCACCGACCACATTC<br>CAAAAGGCCAGGTAAACTTCTCTTCTTTAGCTG<br>GACACCCGAACAACCACGCTGACACGGCGACAA<br>CTAACAGACATTCTTCGCCAATCAACTCGCACC<br>CTTCGCAGCCAACGTCGTCGGCCAAGTCCTCTC<br>CTGCCCGGCCTCCTCCAAGCCCACACACATCCG<br>CTGGATAATCAACGACGGCGTCGTCCCGCTCAC<br>AGGCATCAAAGGATGCAAGCCCGACAAAAACGG<br>CATGTGCGAGATCAACACGTTCATCGCGGGCAT<br>GAAGCAGCGCATGCAGGAGATCGACTTCAACTT<br>TGACTGTTTCGCGAACTACACCGTGCCTATTCC<br>TGATGACATCGTCAATGGGCAGTACCCGCAGAA<br>CTTGAAGCCTAAGAAGAAGTAG |
| Psilocybe cubensis,<br>Strain: MGC-MH-<br>2018 (PsiP2)<br>GenBank:<br>JAFIQS010000001.1 | 16 | ATGCTGGGTCTTCCTTTACCTTGTCTTTGGTT<br>GGGCTTTTGTGCTTGATATCCGACGTTGCGGCA<br>GGGTCTCCTCCGTTGGCCTCCTCGTTCGCTGGA<br>TCAACGACCAGTGCGGTGTTCCCACCTCCCAAC<br>GCTACTATAACAGCCACAGACACATTCTTTCCG<br>GATGCTTCGGACATTGGCTTTGCTGGTCCTACT<br>CCAAGTAAGCTATCAAGTTGTGCATGATATTGG<br>GTGTTTCTAGTAACCGTCTTCTTAGCTGGAGAC<br>GAAGCCAATGCAATAGCCACTGCCCCAGTGAAT<br>GCTAAAGTGGACAATTTCTTCCCTCTAATCAAT<br>CCTGGGGCGCAGGATACGAAGAAAAATAAGCCT<br>TTCGATGTTTTGGTGCACGCCGGAAGTTTAAGT<br>CCCTGGCAATCAGTCGATTCTTTCGGACTGCCA<br>GACGCATCTCCGGTTATACCGCAAGGGTGTGAG<br>CTTGTTCAGGCACACCTTCTTCACCGTCATGGA<br>GCCAGATATCCAACATCTGGTAGCGGACCTGCT<br>AATTTCGCGGCTAAAGTTCACGCAGCAGCCACA<br>GGTGCTGGATTTTCTGCAACGGGTGCTCTTAGC<br>TTCTTGAACACCTGGACCTATAAACTTGGCGCG<br>GAATTACTGACCCCATTTGGTCGTTCACAATTG<br>TAAAATTTCTTTATTTTTCAAATTTGCATAACC<br>AACAGTTATACGAATAGGTTCAACTTGGGAGTT<br>GGGTTCAGAGTGAAATATGGTCCGCGAGTTATA<br>TATTGAAGTAGTACATTGTCACCTAGCTAATAC<br>AAATTCTAGGAGAACTACTCAAGGACTTTAAAG<br>ATTTGCCTGTCTTTCGCACAACCTCTGAAGGTA<br>TTTTGATGTACGTATTTCCTTCTACATGTGGCT<br>GACGTGGTAACTGTAGCTCGAATGGTAGATTCA<br>GCGTCGGTATTATTGTTTTTCAGGAGTGGCCTT |

TABLE 2-continued

Exemplary genes and gene sequences encoding gene products that can be upregulated or downregulated in genetically modified organisms described herein.

| Name | SEQ ID NO: | Sequence |
|---|---|---|
| | | GAGTTAATGCCTTTCCTTTATTTTTAGCGTACA TTTTGCTGCAGGTTTTTTCGGCGTTCAAACGTA CCAACAAGAATATCACCAGCTTATCACCATTGA AAACGATGGTCAAATAATACCCTTGCTCCCTA CGAAACCTGTACTAATAGTAATAATGCTATCGG CTCTTTCGGAAACGTCCAGTCGGCAAATGGGC AGACGTTTACACAGCACCTATAATAAAAAGACT CGGAAAAGACTTGAACGGTCTTCGACTTACAGC GACCGACGTAACTTCAATGCAGCAGTTATGTGC TTATGAGGTAGGCGGATGAACCGATGTCACCAG CTTCCATCTTACAGGTTACCGCTCAGACCGTGG CTCTCGGGTTTTCCCAGTTCTGTAATTTGTTTA CTGAAGATGAATGGAAATCTTTCGAATACTTGA ATGGTGCGTCTAACACTTGGATTGTTTTACGTT ATGTTGAATGTGCGTTTTAGATCTCTCATTTTG GTACTCCAATGGACCTGGAAATCCCACCTCCAG TGCAATGGGCATTGGATATGTACAAGAACTTGT TTCACGACTTACAAAAACACGAATTACAACTTT TAATACGTCTGTCAATGCCTCGATTGTGACTGA CGAAGTGCTCTTTCCACTTGACCAGCCCATATT TGTGGATGCATCTCATGATACCATCCTTTCTGC AAGTAAGCAAGATCATTTTAATGCCATGGTCTC AGTGTATAACAAATAGATCTAGTATTCGTTGCT ATGAATTTTACCAGCCTTGCAGCAAATGGCCCA TTGCCAACAGATCATATACCGAAGGATCAGGTG GGAGATACCCCGGCTTATTTGAACATTTCTTA TTTTATTTTTTAGACATACTTTGTCAACCAAAT TGCACCCTTTGCTTCCAACCTTGTTGGACAGGT TCTTTCTTGCTCTGCGTCTACAAAGCCAACTCA CATTCGATGGATTCTGAACGACGGCGTTTTACC CCTTACTGGTATCAAAGGTTGCAAGGCCAATAA GGATGGAATGTGTGACCTGGAAGCCTTTATTTC TGGAATGAAGGCACGAATCGCGGAGGTGGACTT CGCATTTGACTGCTTTGCAAACTTTACCATTCC TATCCCTGATAATATAGTCAATGGGCAGTTTCC TAAGTAG |
| PsiM (from P. Azurescence) | 67 | ATGCATATCAGAAACCCATATAGAACACCAATC GATTATCAAGCACTCGTCGAAGCATTCCCACCA CTCAAACCATATGTCACAGTCAACCAAGATAAC ACAACATCTATCGATCTCACAGTCCCAGAAGTC CAAAGACTCTATACAGCAGCACTCCTCCATAGA GATTTCGGACTCGTCATCGATCTCCCAGAAGAT AGACTCTGCCCAACACTCCTCACAAGAACACCA TCTCTCAACTATGTCCTCTGGGTCGAAGATATC CTCAAAGTCACAAACACAGCACTCGGACTCTCT GAAGATAGACCAGTCAAAGGAATCGATATCGGA ACAGGAGCAGCAGCAATCTATCCAATGCTCGCA TGCGCAAGATTCAAAACATGGTCTATGATCGGA ACAGAAATCGATAGAAAATGCATCGATACAGCA AGAGTCAACGTCCTCACAAACAACCTCCAAGAT AGACTCTCTATCATCGAAACATCTATCGATGGA CCAATCCTCGTCCCAATCTTCGAAGCAACAACA GATTATGAATATGATTTCACAATGTGCAACCCA CCATTCTATGATGGAGCAGCAGATATGCAAACA TCTGATGCAGCAAAAGGATTCGGATTCGGAGTC AACGCACCACATTCTGGAACAGTCATCGAAATG TCTACAGAAGGAGGAGAATCTGCATTCGTCGCA CAAATGGTCAGAGAATCTCTCGATCATAGAACA AGATGCAGATGGTTCACATCTAACCTCGGAAAA CTCAAATCTCTCCATGAAATCGTCGGACTCCTC AGAGAACATCAAATCTCTAACTATGCAATCAAC GAATATGTCCAAGGAACAACAAGAAGATATGCA ATCGCATGGTCTTTCACAAACATCAGACTCCCA GAAGATCTCACAAGACCATCTAACCCAGAACTC TCTTCTCTCTTCTGA |
| Psilocybe cubensis PsiR (PcuPsiR) | 17 | GCACCCGCAACACCCGCAACTCACGATCCTGCC TTGTCCCACGGAGCCCCTCCTGCTCCAGGTGCT CCAGCTCCTGCAAATGCTCCTCCAAACGCCTCA GGAGACATTGCTGGAATGCAGCTCAGCGGACTC GATCAGTCCCAGATCATGAACCTTCTTCGTTCA TTGCCTGGCATGTTCTCGGGCGGTAAAATACCC GACCAAGGCCAAGGCAACAAAGAGGATGCTGCT |

| Name | SEQ ID NO: | Sequence |
|---|---|---|
| | | CAAACGCTGTCCAACCTTGCCCAAGCTCAACCG<br>TATGGACAACAATTACCCCTTCACTACCAAGCT<br>GGCGGCCCAGGAGGTCTGCCAGGAATTAACGAC<br>CCAGGCCCGTCCACACATCCCCGCGGCCCTCCC<br>AACCTTGGCCAACTGAGTGCTGTGGCAATGCAA<br>GCCGCCCCCGCTCCAATTCAGCATCCAGACCAG<br>CAAACGAACCGCAACGATGGCGAGCAGGCTGGC<br>AATGCGAGTGCAAGTACCTCCGGAAAGGATGGT<br>GACAATGCAGAATTCGTTCCCCCACCTGCTCCT<br>GCTCCTACAACTGGTCGCCGTGGTGGACGCAGC<br>GCCACCATGGGAAGTGACGAATGGAGCAGACAG<br>AGGAAGGATAATCATAAAGAGGTTGAGCGTCGA<br>CGCCGCGGCAATATCAACGAGGGCATCAACGAG<br>CTTGGCCGCATTGTACCCAGTGGGTCTGGCGAG<br>AAGGCCAAAGGCGCCATCCTTTCTCGAGCTGTG<br>CAGTACATCCATCATTTGAAAGAGAACGAAGCT<br>CGCAATATCGAGAAGTGGACCCTTGAGAAGCTT<br>CTCATGGACCAGGCCATGGGTGACCTGCAGGCG<br>CAACTCGAAGAGGTCAAGCGTCTGTGGGAAGAA<br>GAGCGTATGGCGCGCACAAGACTCGAGGCCGAG<br>CTCGAAGTGTTGAGAAATATGAACGGCGTGAAT<br>GCTGGCTCGGCCCCGGCCTCGAAAGATGAGAGT<br>GCTGCAGGTACTAAGAGGAGGAGTACCGATGGA<br>GCAGAGGCCGCCACCGCCGCCACGAAAGCAGCA<br>CCGCCAATGCCGAGGGCGAACGCGACGGCAAGC<br>GACAAAGAACCGAGTGA |
| Psilocybe cyanescens<br>PsiH2 (PcyPsiH2) | 18 | GCACCTCTCACCACCATGATCCCCATAGTACTC<br>TCGCTCCTCATAGCAGGATGCATATACTACATC<br>AACGCTCGCAGGATAAAGCGTTCCCGCTTACCC<br>CCTGGACCGCCTGGCATACCTATCCCATTCATT<br>GGGAATATGTTTGATATGCCTTCAGAGTCTCCA<br>TGGTTGATCTTTTTACAATGGGGACAGGAATAT<br>CAAACCGACATCATCTACGTCGATGCTGGAGGA<br>ACGGACATGATTATTCTGAACTCATTGGAGGCT<br>ATAACCGACTTGTTGGAAAAGCGGGGGTCCCTG<br>TACTCCGGTCGACTCGAGAGCACGATGGTGAAC<br>GAGCTCATGGGATGGGAGTTCGATTTTGGATTC<br>ATACCCTACGGCGAGAGATGGCGCGAAGAAAGG<br>CGCATGTTCGCCAAGGAGTTCAGCGAGAAAAAT<br>ATAAGGCAATTCCGCCACGCTCAAGTGAAGGCT<br>GCCAATCAGCTTGTCCGGCAGCTGACAGACAAG<br>CCAGATCGTTGGTCACACCACATCCGGCATCAG<br>ATAGCGTCTATGGCTCTGGATATTGGCTATGGG<br>ATCGATCTGGCCGAGGATGATCCCTGGATTGCA<br>GCATCTGAGCTAGCAAACGAAGGGCTCGCTGTT<br>GCATCAGTGCCGGGCAGTTTCTGGGTCGACACA<br>TTCCCTTTCCTTAAATACCTTCCGTCCTGGCTT<br>CCAGGTGCTGAATTCAAGCGCAATGCAAAGATG<br>TGGAAGGAAGGCGCTGACCATATGGTGAATATG<br>CCATATGAAACAATGAAAAAACTGTCTGCTCAA<br>GGTTTGACCCGACCCTCATACGCCTCGGCTCGC<br>CTCCAGGCTATGGATCCTAATGGCGATCTCGAG<br>CACCAGGAACGTGTGATCAAGAATACGGCCACA<br>CAAGTCAATGTCGGTGGCGGTGATACGACTGTC<br>GGTGCTGTGTCAGCATTTATTTTAGCTATGGTC<br>AAATATCCCGAGGTTCAACGTAAAGTCCAAGCT<br>GAGCTGGATGAATTCACGAGTAAAGGCCGTATC<br>CCAGATTACGACGAAGATAACGACTCCTTGCCG<br>TATCTCAGCGCATGCTTTAAGGAACTCTTTCGA<br>TGGGGCCAGATTGCACCCCTTGCTATTGCTCAT<br>CGACTTATCAAGGATGATGTTTACCGCGAGTAT<br>ACTATACCTAAGAATGCTTTGGTCTTCGCTAAT<br>AATTGGTACGGACGGACTGTACTGAACGATCCC<br>TCTGAGTATCCAAATCCCTCTGAGTTCCGTCCA<br>GAACGATATCTCGGTCCTGACGGGAAGCCCGAC<br>GATACGGTTCGTGATCCCCGCAAAGCAGCATTC<br>GGGTATGGTCGTCGCGTTTGCCCTGGAATCCAC<br>CTTGCTCAGTCGACGGTATGGATTGCAGGGGTG<br>GCTCTTGTGTCCGCGTTCAACATCGAACTGCCT<br>GTTGATAAGGATGGGAAATGTATTGACATACCA<br>GCGGCGTTTACAACAGGATTTTTCAGGTAA |

TABLE 2-continued

Exemplary genes and gene sequences encoding gene products that can be upregulated or downregulated in genetically modified organisms described herein.

| Name | SEQ ID NO: | Sequence |
|---|---|---|
| *Psilocybe tampanensis* PsiH2 (PtPsiH2) | 19 | CAAAACGGCGCACTCACTGTATTTGTTGCATTT ATTTCTGCAGCGTGCATATACTATGTGCACGCT CGTCGGGCTCGGCGAGCCTCGCTGCCACCAGGT CCGCGCGGAATACCCCTGCCATTTGTGGGGAAT GTATTCGATATGCCTTCGGAGTCTTCTTGGCTC ACGTTCCTGGAATGGGGAAAACAGTATCAATCT GATTTGATCTACTTAAACTCCGGGGGAATAGAA ATGGTCATTCTGAACACGTTGGAAACAATGACC GATCTCTTGGAGAAGAGGGGATCTATATATTCA GGACGACTAGAAAGTACAATGGTCAATGAACTC ATGGGTTGGAAATTCGATTTTGGATTCGTGACC TATGGCGAGCGCtGGCGAGAAGAAAGACGCATG TTTTCGAGGGAGTTCAACGAGAAAAATATCAAA CAATTTCGTCATGCACAAGTCAAGGCCCTCAAA GAACTCGTTCGGAAACTTGACAAAGACCCAAGT CGATGGTACCAGCATCTTCGACACCAAATTGCA TCTATGGCCTTGGATATTGGCTATGGAATTGAT CTCGCAGAAAACGACCCATGGATTGAAGAGACC ATCCTCGCAAACGATGCTCTAGCCCTTGCATCT GTCCCTGGGTGCTATTGGGTTGACTCGTTTCCC ATTCTTCAATATGTTCCATCTTGGCTTCCCTTT GCAGGATTCAAGCGCAAAGCAAAGGTGTGGAAG AAAAATACCGAGTACATGGTCAACGTTCTATAC GAGACCATGAAAAGACAGACAGTACAAGGGTTA ACCCGTCCATCCTATGCTTCAGCACGTTTACAG GCCATGGCTCCAGACATTAACCTTGAACATCAA GAACGGGTAATTAAAAATTCAGCCTCACAGGTT ATTGTTGGCGGTGGCGATACTACCGTGTCTGCA TTGGCAGCATTTATTCTAGCTATGGTCAAATAT CCTAATGTCCAACGCAAGGTCCAGGCGGAGCTC GACGCGATCGCGAGCCAAAACGAAATACCCGAC TTTGACGAAGAAAATGGAACGATGCCATACCTC ACCGCATGTCTCAAAGAAGTTTTCCGCTGGAAC CAGATCGCGCCCCTTGGTATCGCCCACCGGCTT GACAAGGACGATTCTTACCGTGGCTACCTCATA CCCAAGGGAACCTTGGTTTTTGCCAACATTTGG GCTATCTTGAACGATCCATTGATGTATCCTAAT CCTGGCGAGTTTCAACCTGAGCGATATCTCGGA CCTGACGGCAAGCACGATCCCTCTGTGCGCGAC CCACGTAAAATTGCCTTCGGCTGGGGTCGACGC GCTTGTCCCGGCATATACTTGGCACAATCCACC GTATGGCACACAGCAACGAACCTCCTCTCTGCA TTCAACATAGAGCCACCTCTTAACGAAGAGGGA AAGCCTATCAAAGTCGAGGCGGCTTTCACCACT GGATTTTTCAGGTATAGTCCCCGCAGTGATGCA TGA |
| PsiD (*P. Cubensis* genomic sequence) | 90 | atgcaggtgatacccgcgtgcaactcggcagca ataagatcactatgtcctactcccgagtcttt agaaacatgggatggctctctgtcagcgatgcg gtctacagcgagttcataggagagttggctacc cgcgcttccaatcgaaattactccaacgagttc ggcctcatgcaacctatccaggaattcaaggct ttcattgaaagcgacccggtggtgcaccaagaa tttattgacatgttcgagggcattcaggactct ccaaggaattatcaggaactatgtaatatgttc aacgatatctttcgcaaagctcccgtctacgga gaccttggccctcccgtttatatgattatggcc aaattaatgaacacccgagcgggcttctctgca ttcacgagacaaaggttgaaccttcacttcaaa aaacttttcgatacctggggattgttcctgtct tcgaaagattctcgaaatgttcttgtggccgac cagttcgacgacagacattgcggctggttgaac gagcgggccttgtctgctatggttaaacattac aatggacgcgcatttgatgaagtcttcctctgc gataaaaatgccccatactacggcttcaactct tacgacgacttctttaatcgcagatttcgaaac cgagatatcgaccgacctgtagtcggtggagtt aacaacaccaccctcatttctgctgcttgcgaa tcactttcctacaacgtctcttatgacgtccag tctctcgacactttagttttcaaaggagagact tattcgcttaagcatttgctgaataatgaccct ttcaccccacaattcgagcatgggagtattcta |

TABLE 2-continued

Exemplary genes and gene sequences encoding gene products that can be upregulated or downregulated in genetically modified organisms described herein.

| Name | SEQ ID NO: | Sequence |
|------|------------|----------|
| | | caaggattcttgaacgtcaccgcttaccaccga<br>tggcacgcacccgtcaatgggacaatcgtcaaa<br>atcatcaacgttccaggtacctactttgcgcaa<br>gccccgagcacgattggcgaccctatcccggat<br>aacgattacgacccacctccttaccttaagtct<br>cttgtctacttctctaatattgccgcaaggcaa<br>attatgtttattgaagccgacaacaaggaaatt<br>ggcctcattttccttgtgttcatcggcatgacc<br>gaaatctcgacatgtgaagccacggtgtccgaa<br>ggtcaacacgtcaatcgtggcgatgacttggga<br>atgttccatttcggtggttcttcgttcgcgctt<br>ggtctgaggaaggattgcagggcagagatcgtt<br>gaaaagttcaccgaacccggaacagtgatcaga<br>atcaacgaagtcgtcgctgctctaaaggcttag |
| PsiM (*P. Azurescens*) | 91 | ATGCATATCAGAAACCCATATAGAACACCAATC<br>GATTATCAAGCACTCGTCGAAGCATTCCCACCA<br>CTCAAACCATATGTCACAGTCAACCAAGATAAC<br>ACAACATCTATCGATCTCACAGTCCCAGAAGTC<br>CAAAGACTCTATACAGCAGCACTCCTCCATAGA<br>GATTTCGGACTCGTCATCGATCTCCCAGAAGAT<br>AGACTCTGCCCAACACTCCTCACAAGAACACCA<br>TCTCTCAACTATGTCCTCTGGGTCGAAGATATC<br>CTCAAAGTCACAAACACAGCACTCGGACTCTCT<br>GAAGATAGACCAGTCAAAGGAATCGATATCGGA<br>ACAGGAGCAGCAGCAATCTATCCAATGCTCGCA<br>TGCGCAAGATTCAAAACATGGTCTATGATCGGA<br>ACAGAAATCGATAGAAAATGCATCGATACAGCA<br>AGAGTCAACGTCCTCACAAACAACCTCCAAGAT<br>AGACTCTCTATCATCGAAACATCTATCGATGGA<br>CCAATCCTCGTCCCAATCTTCGAAGCAACAACA<br>GATTATGAATATGATTTCACAATGTGCAACCCA<br>CCATTCTATGATGGAGCAGCAGATATGCAAACA<br>TCTGATGCAGCAAAAGGATTCGGATTCGGAGTC<br>AACGCACCACATTCTGGAACAGTCATCGAAATG<br>TCTACAGAAGGAGGAGAATCTGCATTCGTCGCA<br>CAAATGGTCAGAGAATCTCTCGATCATAGAACA<br>AGATGCAGATGGTTCACATCTAACCTCGGAAAA<br>CTCAAATCTCTCCATGAAATCGTCGGACTCCTC<br>AGAGAACATCAAATCTCTAACTATGCAATCAAC<br>GAATATGTCCAAGGAACAACAAGAAGATATGCA<br>ATCGCATGGTCTTTCACAAACATCAGACTCCCA<br>GAAGATCTCACAAGACCATCTAACCCAGAACTC<br>TCTTCTCTCTTCTGA |
| Aromatic L-amino<br>acid decarboxylase<br>from *P. cubensis*<br>(PcAAAD) | 92 | ATGCCATCTTCTCATCCACATATCACACATAGA<br>TATAGAGTCCCATCTTCTGATGATCATGAAAGA<br>ATCTCTGCACTCTTCCTCGGACCAAAAGCAGAA<br>AACGCAGCATTCCTCCAACAATGGCTCACAACA<br>GTCGTCGCACAACAAAAAGCAGCAAGAGATGCA<br>TATTTCCCAGATGATAACGCATTCATCACAACA<br>GATATGCAAACATCTCCAGCATTCGCACAAACA<br>ACAAAAGTCATCGCATCTAACCTCACAGAACTC<br>CTCACAGCACTCGGAGAAAGATCTATCCCATTC<br>TTCTCTCCAAGATATTCTGGACATATGTCTGTC<br>GATCAATCTCTCCCAGCAATCCTCGGATTCCTC<br>TCTACAACATTCTATAACCCAAACAACGTCGCA<br>TTCGAAGCATCTCCATTCACAACACTCATCGAA<br>GAAGAAGTCGGACTCCAACTCTCTGAAATGCTC<br>GGATATAACAGACTCAACAACACAGAAAAACCA<br>CTCGCATGGGACATATCGCATCTGGAGGAACA<br>GTCGCAAACCTCGAAGCAATGTGGGCAGCAAGA<br>AACCTCAAATTCTATCCACTCTCTCTCAGAGAT<br>GCATCTGCAGAAGGAGCAGAAATGGAATTCATC<br>AGAGATACATTCTCTGTCAAAACATGCGTCGGA<br>GATAAAAAACTCCTCAAAGATTGCTCTCCATGG<br>GAACTCCTCAACCTCCATGTCTCTACAATCCTC<br>GATATGCCAGATAGACTCCATGATGAATATAAC<br>ATCTCTCCACAATTCCTCGAAAAAGTCATGAGA<br>AAATATATCATCCAATCTACAAACAAAGATACA<br>CTCATGCAAAGATGGGGACTCACACAACAACCA<br>GTCGTCCTCTCTCCATCTACAAACCATTATTCT<br>TGGCCAAAAGCAGCAGCAGTCCTCGGAATCGGA<br>TCTGATAACCTCAGAAACGTCCCAGTCGATATC |

TABLE 2-continued

Exemplary genes and gene sequences encoding gene products that can be upregulated or downregulated in genetically modified organisms described herein.

| Name | SEQ ID NO: | Sequence |
|---|---|---|
| | | CAAGCACATATGGATATCAACGAACTCGATAGA<br>ATGCTCAAAATCTGCCTCGATGAAGAAACACCA<br>GTCTATCAAGTCGTCGCAGTCATCGGAACAACA<br>GAAGAAGGAGGAGTCGATAGAATCACAGAAATC<br>CTCAAACTCAGACAAAAATATGAAGCACTCGGA<br>CTCTCTTTCGCAATCCATGCAGATGCAGCATGG<br>GGAGGATATTTCGCAACAATGCTCCCAAAAGAT<br>ACACTCGGAAGAAACAGAACAAGACTCCCAAAA<br>GAAGATACAACATCTGGATTCGTCCCACATGTC<br>GGACTCAGAGAAGAATCTGCACTCCAACTCTCT<br>CATATCAAATATGCAGATTCTATCACAATCGAT<br>CCACATAAAGCAGGATATGTCCCATATCCAGCA<br>GGAGCACTCTGCTATAGAGATGGAAGAATGAGA<br>TATCTCCTCACATGGTCTGCACCATATCTCGCA<br>CAAGGAAACGAAGGACAATCTATCGGAATCTAT<br>GGAATCGAAGGATCTAAACCAGGAGCAGCAGCA<br>TCTGCAGTCTTCATGGCACATGAAACAATCGGA<br>CTCACACCATCTGGATATGGAAACCTCCTCGGA<br>CAAGCAATGTTCACATGCAGAAGATATGCAGCA<br>CATTGGTCTGCAATGTCTACAGATACAACATCT<br>TTCACAGTCACACCATTCAACCCAATCCCAGCA<br>GATATCGATCCAAACGCAGATCCAGCAAAAGTC<br>GAAGAACAAAAACAATTCATCAGAGATAGAATC<br>CTCTTCAAATCTAACGAAGAAATCTATAACGAT<br>TCTGAAGCAATGGAACTCCTCCATCAACTCGGA<br>TCTGATCTCAACATCAACGTCTTCGCATGCAAC<br>TTCAGAGATAGAGATAACAACCTCAACACAGAT<br>GTCGAAGAAGCAAACTGGCTCAACAACAGAATC<br>TTCCAAAGATTCTCTGTCACATCTGCAGAAGAA<br>AACCCACTCGAAACACCATTCTTCCTCTCTTCT<br>ACAACACTCAAACAATCTGAATATGGAGTCTGC<br>GCAACAGAAGTCAAAAGAAGAATGGGACTCGTC<br>GGAGATCAAGATGTCATCGTCCTCAGAAACGTC<br>GTCATGTCTCCATTCACAACAACAAACGATTTC<br>GTCGGAACACTCGCAAACACATTCCAAAAAATC<br>GTCGAAGAAGTCGAATATGCAAGAATCAGA<br>AACGATATGAAACCATCTATCCATACATTCCTC<br>CTCCATGGATCTGGAGAACAATATTATCTCGTC<br>CATACACCAACAATCCATATGGCATCTGGAAGA<br>AGACAAATCATCCTCTCTGTCAACGTCGAAGGA<br>CAAGTCAGACAAGCAATCCATGCACATGAAAGA<br>GTCGAAGCAGTCATCGTCCATAACACAGTCCCA<br>CTCAGACTCGATGAAATCGTCGATGGAGGATCT<br>TTCGATGGAATCCTCACAATCGGAAAAAGAAAA<br>ACATCTTTCAAAGTCAAAATCTCTAACATCAAA<br>GTCGTCAAAAAAAGATCTCTCATGACAGAAGAT<br>CTCGAATCTGCATATCCATCTCTCATGCCATTC<br>TATTTCTATGGAACACAAGGACATGCACATCTC<br>GATCATGTCATCACAGTCGTCCCAAACATCCAT<br>CTCTCTGCAGGAGAAATCCAATATAAATTCGAT<br>GATGAAGTCTCTTCTGAAGATCTCGCAAAAGGA<br>CTCATCGTCGTCGCAGAAAACGTCCATGAAGCA<br>TCTATGCAACCATTCCCACTCATGAAAGATTTC<br>AAAATCACAAACCAATTCTTCTTCTCTTCTGGA<br>CAAATCCTCAGAGTCAAAGTCTATAGAGATCCA<br>TATCCAGCATCTACAATGGATCCAATCCCACTC<br>CATGATATCAAAAACCAACCAGTCGTCACACAA<br>GGAACAATCACACTCGTCGGAAACATCTATGTC<br>GATTCTGATGCACTCAACGTCGCATCTGAACCA<br>ACAGCAGATGAAGATGCAGCACATGTCCCACAT<br>GCAAGAAACATGTATGGAGAAATGACAGCAGGA<br>ACAATCAAAGGATGGCAAAACGCAGTCAGACAT<br>TTCCATAACAAACTCGAAACAGTCGCACCAACA<br>AAA |
| PsiM Psilocybe cubensis | 93 | ATGCATATCAGAAACCCATATAGAACACCAATC<br>GATTATCAAGCACTCTCTGAAGCATTCCCACCA<br>CTCAAACCATTCGTCTCTGTCAACGCAGATGGA<br>ACATCTTCTGTCGATCTCACAATCCCAGAAGCA<br>CAAAGAGCATTCACAGCAGCACTCCTCCATAGA<br>GATTTCGGACTCACAATGACAATCCCAGAAGAT<br>AGACTCTGCCCAACAGTCCCAAACAGACTCAAC<br>TATGTCCTCTGGATCGAAGATATCTTCAACTAT<br>ACAAACAAAACACTCGGACTCTCTGATGATAGA |

TABLE 2-continued

Exemplary genes and gene sequences encoding gene products that can be upregulated or downregulated in genetically modified organisms described herein.

| Name | SEQ ID NO: | Sequence |
|---|---|---|
| | | CCAATCAGAGGAGTCGATATCGGAACAGGAGCA<br>TCTGCAATCTATCCAATGCTCGCATGCGCAAGA<br>TTCAAAGCATGGTCTATGGTCGGAACAGAAGTC<br>GAAAGAAAATGCATCGATACAGCAAGACTCAAC<br>GTCGTCGCAAACAACCTCCAAGATAGACTCTCT<br>ATCCTCGAAACATCTATCGATGGACCAATCCTC<br>GTCCCAATCTTCGAAGCAACAGAAGAATATGAA<br>TATGAATTCACAATGTGCAACCCACCATTCTAT<br>GATGGAGCAGCAGATATGCAAACATCTGATGCA<br>GCAAAAGGATTCGGATTCGGAGTCGGAGCACCA<br>CATTCTGGAACAGTCATCGAAATGTCTACAGAA<br>GGAGGAGAATCTGCATTCGTCGCACAAATGGTC<br>AGAGAATCTCTCAAACTCAGAACAAGATGCAGA<br>TGGTATACATCTAACCTCGGAAAACTCAAATCT<br>CTCAAAGAAATCGTCGGACTCCTCAAAGAACTC<br>GAAATCTCTAACTATGCAATCAACGAATATGTC<br>CAAGGATCTACAAGAAGATATGCAGTCGCATGG<br>TCTTTCACAGATATCCAACTCCCAGAAGAACTC<br>TCTAGACCATCTAACCCAGAACTCTCTTCTCTC<br>TTC |
| TrpM<br>P. serbica | 94 | ATGCCAAGAATCCAAGTCCTCGATATCAGAGGA<br>TCTAAAGAATCTGTCGGATCTACACCACATCTC<br>AGAGCAGCAATCCTCGAAGGACTCCTCAAACCA<br>CCAGGATCTAGAACACTCCCATCTGAAACACTC<br>TATGATGAAGTCGGACTCAAAATGTATAACGAT<br>GGAATGAAAGCATGGGCAGAATGGTATTATCCA<br>GTCGAAGCAGAAAGACAAATCCTCGAAAGATAT<br>GGAAGAGATATCGCAAAACTCTTCACAACATCT<br>GCAAAAGGAAAAGCAGTCCTCATCGAACTCGGA<br>GCAGGATCTCTCGATAAAACATCTCAAGTCCTC<br>CTCTCTGCAGCAGAAATCACAAGAACAACAGGA<br>CCAATGAACAACATCGCATATTATGCACTCGAT<br>CTCGAAAGAGGAGAACTCGAAAGAACAATCGGA<br>AGACTCCAAGAAGTCATCGGAGATCAAATCGCA<br>GGAAAAATCTCTACAGCAGGAATGTGGGGAACA<br>TATGATGATGGAATCAGAGTCATCGAAAAAAAC<br>GAACTCGAACTCGAACCAGATATCCCAGTCCAT<br>ATCCTCTTCCTCGGAGGAACAATCGGAAACTTC<br>TCTAAACAAGATGGAGATGTCGCATTCCTCAAA<br>TCTCTCCCACTCGATCATAAAAGAGGAGATACA<br>CTCCTCGTCGGAATGGATAGACATAAATCTGCA<br>GATGCAATCGAAAGATCTTATGGATTCGCAGCA<br>GCAAAAGATTGGATCATGAACGGACTCAAAGTC<br>TCTGGAAGAGTCCTCACAGGAGATGAAGGACTC<br>TTCGAAATCGGAAACTGGGAAAGATATGCAAAA<br>TATAACGAAGAACTCGGAAGATATGAAGCAGGA<br>TATAAATCTCAAAAAGAACATGCACTCAAAATC<br>TCTGAAGGAGTCGATATCACATTCCTCAAAGAT<br>GAAGTCGTCCTCGTCATGTTCTCTAACAAATAT<br>ACAGATGCAGAAATGGATTCTGTCGTCGATTCT<br>GCAGGACTCGTCAAAAACGGATCTTGGATGGAT<br>GAAAAAGCACAATATTGCCTCCTCTCTCTCAGA<br>GCAAACAACGGACCAGTCTGA |
| STST<br>strictosidine<br>synthase<br>from Catharanthus<br>roseus | 95 | ATGGCAAACTTCTCTGAATCTAAATCTATGATG<br>GCAGTCTTCTTCATGTTCTTCCTCCTCCTCCTC<br>TCTTCTTCTTCTTCTTCTTCTTCTTCTTCTCCA<br>ATCCTCAAAAAAATCTTCATCGAATCTCCATCT<br>TATGCACCAAACGCATTCACATTCGATTCTACA<br>GATAAAGGATTCTATACATCTGTCCAAGATGGA<br>AGAGTCATCAAATATGAAGGACCAAACTCTGGA<br>TTCACAGATTTCGCATATGCATCTCCATTCTGG<br>AACAAAGCATTCTGCGAAAACTCTACAGATCCA<br>GAAAAAAGACCACTCTGCGGAAGAACATATGAT<br>ATCTCTTATGATTATAAAAACTCTCAAATGTAT<br>ATCGTCGATGGACATTATCATCTCTGCGTCGTC<br>GGAAAAGAAGGAGGATATGCAACACAACTCGCA<br>ACATCTGTCCAAGGAGTCCCCATTCAAATGGCTC<br>TATGCAGTCACAGTCGATCAAAGAACAGGAATC<br>GTCTATTTCACAGATGTGCTCTTCTATCCATGAT<br>GATTCTCCAGAAGGAGTCGAAGAAATCATGAAC<br>ACATCTGATAGAACAGGAAGACTCATGAAATAT<br>GATCCATCTACAAAAGAAACAACACTCCTCCTC |

TABLE 2-continued

Exemplary genes and gene sequences encoding gene products that can be upregulated or downregulated in genetically modified organisms described herein.

| Name | SEQ ID NO: | Sequence |
|---|---|---|
| | | AAAGAACTCCATGTCCCAGGAGGAGCAGAAATC<br>TCTGCAGATGGATCTTTCGTCGTCGTCGCAGAA<br>TTCCTCTCTAACAGAATCGTCAAATATTGGCTC<br>GAAGGACCAAAAAAAGGATCTGCAGAATTCCTC<br>GTCACAATCCCAAACCCAGGAAACATCAAAAGA<br>AACTCTGATGGACATTTCTGGGTCTCTTCTTCT<br>GAAGAACTCGATGGAGGACAACATGGAAGAGTC<br>GTCTCTAGAGGAATCAAATTCGATGGATTCGGA<br>AACATCCTCCAAGTCATCCCACTCCCACCACCA<br>TATGAAGGAGAACATTTCGAACAAATCCAAGAA<br>CATGATGGACTCCTCTATATCGGATCTCTCTTC<br>CATTCTTCTGTCGGAATCCTCGTCTATGATGAT<br>CATGATAACAAAGGAAACTCTTATGTCTCTTCT<br>TGA |
| McbB from marine actinomycete<br>M. thermotolerans | 96 | AGACAAATCGAAATCGAATGGGTCCAACCAGGA<br>ATCACAGTCACAGCAGATCTCTCTTGGGAAAGA<br>AACCCAGAACTCGCAGAACTCCTCTGGACAGGA<br>CTCCTCCCATATAACTCTCTCCAAAACCATGCA<br>CTCGTCTCTGGAAACCATCTCTATCATCTCATC<br>GCAGATCCAAGACTCGTCTATACAGAAGCAAGA<br>TATAAAGAAGATAGAACAAAATCTCCAGATGGA<br>ACAGTCTTCCTCTCTCAACTCCAACATCTCGCA<br>GTCAAATATGGACCACTCACAGAATATCTCCCA<br>GCAGCACCAGTCGGATCTGTCGTCCCAGAAGAT<br>ATCGATGCACTCAGAGAAGCAGGAAGAGCATGC<br>TGGAAAGCAGCATGGGAAACAAAACAACCAATC<br>GAAGTCAGAGTCAGAAGAAAAGGAGAAGCAGTC<br>ACAGATTTCGCACTCCCAAGAACACCACCAGTC<br>GATCATCCAGGAGTCCAAAAACTCGTCGAAGAA<br>ATCCAAGATGAAACAGAAAGAGTCTGGATCACA<br>CCACCAGCAGAAATCGTCGATATGCATCAAGGA<br>AGAATCGCATCTAGAGCAGGATCTTATGATCAA<br>TATTTCTCTACACTCGTCTTCCTCAACGGAGAA<br>GTCAGACCACTCGGATATTGCGCACTCAACGGA<br>CTCCTCAAAATCTGCAGAACAACAGATCTCACA<br>CTCAACGATCTCAAAAGAATCACACCAACATTC<br>ATCAAAACACCAGCAGAATTCCTCGGATATACA<br>GGACTCGATACACTCTGGAGATTCACACAACAA<br>GTCCTCACACTCCTCCCAGATGTCGAAACAAGA<br>GAACAATATTTCGCACTCGTCAACGCACTCGCA<br>CTCTATGCAAACATGCTCAACACATGGAACCTC<br>CATTTCTTCCCATGGCAACATGGAACAGATTAT<br>AGATATCTCGATGCA |
| TrpE<br>P. Cubensis | 97 | ATGGATCCATTGACATTACCCGCGCTACCTACT<br>CTTGCTACTGTCGAGAACTTAATCTTCAACGAA<br>AAACGAGGCAACTGTGTCCCGGTTTACGTGGAA<br>CTTCCAGCCGACTTGATTACACCATGTATGGCC<br>TACTTGCGCATCGCGAAGGATTCTAAGTACAGT<br>TTTCTTTTGGAATCGGTTATTGGAGGAGAGAAT<br>GTCGCCAGATACAGTTTCATCGGAGCTGATCCT<br>CTGAAGGTCATCAAAACTGGCCCTGGAGAGGAA<br>ATTACGGGCGATCCTATGACTGCGCTCCAGAGG<br>GAGCTAGCACTTCATCAATATGTTAAAATCCCT<br>GAAGTACCAACCTTTACTGGTGGCGCCATCGGA<br>TATGTGTCGTACGACTGCATCCAACATTTCGAA<br>CCAAAGACAAAAACCGAGCTCAAAGATGTTCTT<br>GGGATTCCAGAGGCTGTCTTCATGCTTGTCGAT<br>ACTCTTCTCATTTACGATCACATCTTCCAGACC<br>TTGAAGGTTGTGTCACACGTCTTCATTCCGAAA<br>TCATTTGGAACAGGAAATCTTGCCTTTACATAC<br>CAAACTGCTGTGTCGAAGGCGCGCAGGTTGGCC<br>AAACTTCTTTTGTCAACCGCTACTCCTGAGCCT<br>CCACAACCTCCCATAACCTTGGGGAATGAGGGG<br>GTGTCCAACGTCGGAAAAGATGGCTACGAAGGA<br>TTTGTTACGTCTTTGAAGAAACATATCGTCGCT<br>GGAGACATCATTCAGGCTGTACCCTCTCAAAGA<br>CTCAGCAGACCAACTTCACTGCATCCTTTTAAC<br>GCCTACCGTCATCTTCGTCAAATCAACCCCTCG<br>CCGTACATGTTTTACCTGGATTGCGGAGATCTT<br>CAAATTGTTGGTGCAAGTCCTGAAACACTCTGT<br>AAAGTAGAGAAGAATGTCGTCTACAACCATGCC<br>ATTGCTGGTACCATCAAACGAGGGAAAACTCCT |

TABLE 2-continued

Exemplary genes and gene sequences encoding gene products that can be upregulated or downregulated in genetically modified organisms described herein.

| Name | SEQ ID NO: | Sequence |
|---|---|---|
| | | GAAGAGGATGAGAAGCTTGGTGCCGTCCTTCTC<br>GCGTCTGAAAAAGATAGAGCTGAACACATTATG<br>CTCGTCGATTTGGCAAGAAACGATGTCAATCGT<br>GTATGCCAACCGAAGACGGTGAAGGTTGATCAT<br>CTAATGAAAGTCGAGAAATTCAGTCATGTCATC<br>CATCTGACGTCTCAAGTTTCCGGAACTTTAAGA<br>GACGGCCTAACAAGGTTTGATGCTTTCCGATCG<br>ATATTCCCTGCCGGAACTGTTTCTGGTGCCCCC<br>AAGATCAAGGCCATTGAAATCATATCATCTCTT<br>GAGCAGGAACGACGAGGAGTATACGCTGGTGCT<br>GTCGGTCGGTTTGATTTTGCCGAAGACGAGATG<br>GATACTTGTATAGCTATCCGAACCATGACTTTC<br>AAGGACGGCATTGCGTATCTTCAAGCGGGTGGA<br>GGCATCGTGTTTGATAGCGTCGAAGAGGACGAA<br>TATATCGAAACAATTAACAAACTGGGGGGCAAT<br>GTTCGAGCTCTCGAAGAGGCCGAGGAATATTGG<br>TATAAGGTACAGCAAAACCAGGGCACGAAGAAG<br>GCAAACCCTCGGAATGTATAG |
| TrpE *Agaricus bisporium* | 98 | ATGGACCCTCAGAAACTCCCTGCATCGCCATCT<br>TACGAAACCGTCGAGCAATTGATTGTTCATGAA<br>AAGAAAGGAAACTGCGTCCCAGTCTATGTTCAG<br>CTCCCTGCAGACCTGGTTACACCATGTATGGCG<br>TATCTACGGATTGCCAAGGACTCAAAGTATAGC<br>TTTCTCCTTGAGTCAGTCATCAGTGGAGAGAAC<br>GTGGCCCGTTATAGTTTCATCGGTGCAGACCCT<br>CTCAAGATCGTAAAGACAGGCCCCAACGAAGAA<br>TACACCGGCGATCCTATGCTTGCTTTACAGAAA<br>GAACTTTCTCTTCACCAGTACGTCAAGATACCA<br>GAGGTACCAACTTTCACCGGCGGGGCCATTGGC<br>TATGTTGCCTATGATTGCATCCAACACTTCGAG<br>CCCAGGACAAAAACAGAGCTTCATGATTCCTTG<br>CGTATCCCTGAAGCTGTATTCATGCTCGTCGAT<br>ACTCTTCTCATTTACGACCATCTCTTTCAGAAT<br>ATCAAGATCGTTTCTCACGTATTTAGTCCCAAA<br>ACCTCTCCAACTGGAAACCTTGCATTCATCTAC<br>AAAAACTGCAGTTGCCAAAGCTCGCCGTTTGGCT<br>AAAGTTCTTCTCAGCGCTACAACGCCTGAGCCT<br>CACCAACCGCCCATTACAACACTCGAGACCGAA<br>GGTGTTTCCAATGTCGGAAAAGCTGGCTACGAG<br>AAATTTGTGACAAAGCTAAAGGAGCATATAGTT<br>GCTGGGGACATTATCCAAGCAGTTCCTTCTCAG<br>CGGATAGCTCGCAAGACAGATCTACATCCTTTC<br>AATGCATATCGACACCTTCGCCAAGTCAATCCT<br>TCGCCATATATGTTCTTCATCGACTTCGGCGAC<br>TTCCAAATCGTCGGTGCGAGCCCAGAAACCATG<br>TGTAAAGTCGAGAAGAACGTAGTTTTCAACCAT<br>GCTATCGCTGGAACTGTAAAACGAGGCAGAACA<br>CCTGAAGAGGACGAGAGATTGGGGGCCGAGCTC<br>CTAGCCTCAGAAAAGGATCGGGCAGAACACATC<br>ATGCTTGTCGATCTTGCACGAAATGATGTCAAT<br>CGCGTCTGTCAGCCCAAGACCGTCAAGGTTGAT<br>CATTTAATGCAAGTTCAAAAGTTCAGCCATGTC<br>ATTCATTTGACATCTCAAGTTTCTGGTCTCTTG<br>AGGGAGGGAAAAACGAGGTTTGATGCTTTCAGA<br>TCTATCTTCCCCGCCGGGACAGTGTCTGGCGCT<br>CCAAAAATCAAAGCTGTTGAGATTGTTTACTCG<br>CTGGAAAAAGAGAGACGCGGTGTTTACGCTGGA<br>GCTGTGGCCGCTTTGACTTTGCAGACGATGAG<br>ATGGATACTTGTATTGCCATCCGCACCATGGTT<br>TTCAAAGCCGGCACTGCGTACTTACAGGCAGGT<br>GGTGGTATCGTCTTCGACAGTGTTGAAGAAGAT<br>GAGTATATGGAGACCATCAACAAACTCAAGGGA<br>AGCACCTACGCACTTAAGCAAGCAGAAGAACAC<br>TGGCACCAAATCCAGCAGAATCAGTCGCAAAAC<br>ACAGTAGCGTAA |
| *H. sapiens* Indolethylamine N-methyltransferase | 99 | ATGAAAGGAGGATTCACAGGAGGAGATGAATAT<br>CAAAAACATTTCCTCCCAAGAGATTATCTCGCA<br>ACATATTATTCTTTCGATGGATCTCCATCTCCA<br>GAAGCAGAAATGCTCAAATTCAACCTCGAATGC<br>CTCCATAAAACATTCGGACCAGGAGGACTCCAA<br>GGAGATACACTCATCGATATCGGATCTGGACCA<br>ACAATCTATCAAGTCCTCGCAGCATTCGATTCT<br>TTCCAAGATATCACACTCTCTGATTTCACAGAT |

TABLE 2-continued

Exemplary genes and gene sequences encoding gene products that can be upregulated or downregulated in genetically modified organisms described herein.

| Name | SEQ ID NO: | Sequence |
|---|---|---|
| | | AGAAACAGAGAAGAACTCGAAAAATGGCTCAAA AAAGAACCAGGAGCATATGATTGGACACCAGCA GTCAAATTCGCATGCGAACTCGAAGGAAACTCT GGAAGATGGGAAGAAAAAGAAGAAAAACTCAGA GCAGCAGTCAAAAGAGTCCTCAAATGCGATGTC CATCTCGGAAACCCACTCGCACCAGCAGTCCTC CCACTCGCAGATTGCGTCCTCACACTCCTCGCA ATGGAATGCGCATGCTGCTCTCTCGATGCATAT AGAGCAGCACTCTGCAACCTCGCATCTCTCCTC AAACCAGGAGGACATCTCGTCACAACAGTCACA CTCAGACTCCCATCTTATATGGTCGGAAAAGA GAATTCTCTTGCGTCGCACTCGAAAAAGAAGAA GTCGAACAAGCAGTCCTCGATGCAGGATTCGAT ATCGAACAACTCCTCCATTCTCCACAATCTTAT TCTGTCACAAACGCAGCAAACAACGGAGTCTGC TTCATCGTCGCAAGAAAAAAACCAGGACCA |
| >MN117956.1 *Psilocybe cubensis* isolate FSU12409 psilocin laccase (psiL) gene, complete cds | 151 | ATGAATTTTCTTCTAAGCATCGCTACCCTTGGA CTGGGACTTCAAGCCTATGCTGTCATGATAGGT CCCTCCGCGACTTTGGTTATCGGAAACAAAAAC ATAGCTCCCGACGGAATTAAGCGCTCGTAAGTT GACCTTTTATTTTGTTACTCATTCTGTTCCAAA CAATCGCAGGGCTGTTTTAGCTGGAACTTCACT GGACACTCTATCTTTCCCCGGACCTGTAATTCG GGCCACAAAGGTACGTGAATTAATGGCTATTGC AATTTCATGAGTGGGAAACCGAGTGTGCAATTT CTCAGGGCGACACGCTGAGCTTGAACGTCGTCA ATCAGTTAACTGATGCCACTATGCTGATGGGCA CGAGCATCGTGAGTACCTTTGTCTAGCCCTCAT TATATTTCTTGAAGGTTTCTTCAGCATTGGCAT GGTTTTCATCAAAAAGGAACTAGTTGGGCAGAC GGTGTTGTCGGCGTGACTCAGTGCCCTATTGCT CCTGGTCATTCTTTCCTATATCAGTTTCCCACG GCCAACCAAGCTGGGACTTTTTGGTATCATTCT CATTACTGTGCGTATAGAGTCTAGGATATAAAT CAAGGCGGAGATATTGATATATTTACTATACAG CTACACAGTATTGCGATGGCCTTAGAGGAGCTT TGATTGTTTATGATCCAACCGATCCCTATAGAA CCTGGTGCGTGTTTTAATGGTAGCGCTAAAAAT TAGTTTAAATTCATCCTAATTTATTTATATACG TAGGTATGATATCGACGACGGTAAGTCTCCCCT GTTTCGTCCCTTGTTAAGAAGCTGATAGCGACG ATTCTTGTCCTATCATGTGTCACAGAAAGTACA ATCATTACCCTTGCAGATTGGTGGGTTCCAATA TGACGTGTATTGCTCAGCCGTAATCTGACTTCC TTTTCGAAACAAAGGTATCATAAGGCTGCTCCT CTACAGACCCTCCGAACTGCTAAGGAAGATTCA GTTCTGATCAACGGGCAAGGTCGCGTTCCCGGA GATAAAACTACTGATTCAACTCCCTTGTCAGTC ATAAACATAATTCCCCAAAAGCGATATCGGTTC CGTCTCATTTCAATTTCGTGTGATCCTGCATTT TCTTTCTCGATTGATGGTCATTCTATGGTAAGT CCGCTTATCAAATTTGTTAATCTAATTTTCATA TGACATACTACATGATAGACCGTCATCGAAGCT GACTCTCAGAGCGTGCAACCTCTTACTGTGAAT GAAATTACTATCTTCGCCGGTCAACGATATTCT TTTATTCTTTATGCCAATAATCCGGTCGGAAAC TACTGGATTCGGTCGCAGCCTACATACCCAGAT GATGGGATACAAGGCTATGCAGGAGGCATCAAC TCTGCCATACTACGTTACTCTGGAGCCCCCGCA GTCAATCCAACGACAAAAAAGGCTTCCATTACT ATTCCTTTGGTTGAAGCAGATCTACGGCCTCTC TATAGCCCGGCCGCCCCGGGCCTTCCATCTCCA GGAGCTGCCGACGTCAACATCAAGCTCGATATT TCTTACAACTCACCTTCCGAGACGTTTTTCGTT AATAATTCCACCTTCCCAGAAGTCCCGGTTCCA GTGTTGCTCCAGATACTCAGCGGAGCCCAGTCA GCAAATGATTTGCTCCCCGCCGGATCGGTTTAT ACTCTCCCCCTAATAAAGTCATAGAAATATCT ATGCCCGGTGGAAGGCCCGGAAGCCCAGTAAGC TTCTCAGTTACACAAATCGTTTTCAACCACTCT TATCTTGCCGCCTATAGCACCCTATGCATTTGC ATGGCGTATGTGATTGATCTTCATGTAGTTGAC GTTACCTGACGACTCTTTTTAGCACGATTTCTC |

TABLE 2-continued

Exemplary genes and gene sequences encoding gene products that can be upregulated or downregulated in genetically modified organisms described herein.

| Name | SEQ ID NO: | Sequence |
|------|------------|----------|
| | | CGTCGTGCGAAGCGCCGGCAGCAATCGGTACAA CTATGCCAATCCTGTCAGGCGCGACGTAGTGAA CATAGGAATGGAAGATACGGACAACGTTACCAT ACGTTTCAAGACCGACAATTCCGGCCCTTGGAT CCTGCACTGGTGTGTCTGCCTATTCCACTATAG CCACATATTCATGCCCTGATTACGCACACATCA GCCACATTGATTGGCATATTGAGGCGTAAGTCT CAATCAGTGAAAAGCATTTAATGATGAGATTGA ATACCTTTTCTCCAGTGGTTTGGCGGTGGTTTT CACAGAGGACATTCCATCCATTCAATTCAGCAA TCCTCCTCGTACGCCTCCATGTACTATTTTCAT TGATACCCTTGACTCAGATCATTTATCTAGCTG CTTGGGATCAACTTTGTCCCATTTTCAACGCCA TACCTCCTCAAAAGTTCCATTAA |

TABLE 3

Exemplary polypeptides that can be upregulated, downregulated or expressed by an exogenously introduced gene in a genetically modified organism described herein.

| Name: | SEQ ID NO.: | Sequence: |
|-------|-------------|-----------|
| PsiD (from P.cubensis) | 735 | MQVIPACNSAAIRSLCPTPESFRNMGWLSV SDAVYSEFIGELAT RASNRNYSNEFGLMQPIQEFKAFIESDPVV HQEFIDMFEGIQDSPRNYQELCNMENDI FRKAPVYGDLGPPVYMIMAKLMNTRAGFS AFTRQRLNLHFKKLFDTWGLFLSSKDSRN VLVADQFDDRHCGWLNERALSAMVKHYN GRAFDEVFLCDKNAPYYGFNSYDDFFNRR FRNRDIDRPVVGGVNNTTLISAACESLSYN VSYDVQSLDTLVFKGETYSLKHLLNNDPF TPQFEHGSILQGFLNVTAYHRWHAPVNGTI VKIINVPGTYFAQAPSTIGDPIPDNDYD PPPYLKSLVYFSNIAARQIMFIEADNKEIGLI FLVFIGMTEISTCEATVSEGQHVNRG DDLGMFHFGGSSFALGLRKDCRAEIVEKFT EPGTVIRINEVVAALKA |
| PsiD (from P. cyanescens) | 736 | MQVLPACQSSALKTLCPSPEAFRKLGWLPT SDEVYNEFIDDLTGRTCNEKYSSQVTLLKP IQDPKTFIENDPIVYQEFISMFEGIEQSPTNY HELCNMFNDIFRKAPLYGDLGPPVYMIM ARIMNTQAGFSAFTKESLNFHFKKLFDTW GLFLSSKNSRNVLVADQFDDKHYGWFSER AKTAMMINYPGRTFEKVFICDEHVPYHGF TSYDDFFNRRFRDKDTDRPVVGGVTDTTLI GAACESLSYNVSHNVQSLDTLVIKGEAYSL KHLLHNDPFTPQFEHGSIIQGFLNVTAYHR WHSPVNGTIVKIVNVPGTYFAQAPYTIGSPI PDNDRDPPPYLKSLVYFSNIAARQIMFIEAD NKDIGLIFLVFIGMTEISTCEATVCEGQHVN RGDDLGMFHFGGSSFALGLRKDSKAKILE KFAKPGTVIRINELVASVRK |
| PsiH (from P.cubensis) | 737 | MIAVLFSFVIAGCIYYIVSRRVRRSRLPPGPP GIPIPFIGNMFDMPEESPWLTFLQWGRD YNTDILYVDAGGTEMVILNTLETITDLLEK RGSIYSGRLESTMVNELMGWEFDLGFITYG DRWREERRMFAKEFSEKGIKQFRHAQVKA AHQLVQQLTKTPDRWAQHIRHQIAAMSLD IGYGIDLAEDDPWLEATHLANEGLAIASVP GKFWVDSFPSLKYLPAWFPGAVFKRKAKV WREAADHMVDMPYETMRKLAPQGLTRPS YASARLQAMDLNGDLEHQEHVIKNTAAE VNVGGGDTTVSAMSAFILAMVKYPEVQR KVQAELDALTNNGQIPDYDEEDDSLPYLT ACIKELFRWNQIAPLAIPHKLMKDDVYRG YLIPKNTLVFANTWAVLNDPEVYPDPSVFR PERYLGPDGKPDNTVRDPRKAAFGYGRRN |

TABLE 3-continued

Exemplary polypeptides that can be upregulated, downregulated or expressed by an exogenously introduced gene in a genetically modified organism described herein.

| Name: | SEQ ID NO.: | Sequence: |
|---|---|---|
| | | CPGIHLAQSTVWIAGATLLSAFNIERPVDQ NGKPIDIPADFTTGFFR |
| PsiH (from *P. azurescens*) | 20 | MITILLSLLLAGCIYYINARRVRRSHLPPGPP GIPIPFIGNMFDMPSESPWLTFLQWGRD YQTDILYVDAGGSEMIILNSLEAITDLLEKR GSIYSGRLESTMVNELMGWEFDLGFITYG ERWREERRMFAKEFSEKNIRQFRHAQVQA ANRLVRQLIKTPGRWSQHIRHQIAAMSLDI GYGIDLAEDDPWLEATQLANEGLAIASVP GSFWVDSFPSLKYLPSWLPGAGFKRKARV WKEGADHMVNMPYETMKKLSAQGLARPS YASARLQAMDPNGDLEHQEHVIKNTATEV NVGGGDTTVSAMSAFILAMVKYPEVQRK VQAELDVLTSKGLIPDYDEEDDSLPYLTAC VKELFRWNQIAPLAIAHRLIKDDVYRGYTI PKNALVFANTWAVLNDPEEYPDPSEFRPER YLGPDGKPDHTVRDPRKAAFGYGRRTCPG LHLAQSTVWIAGATLLSVFNIERPVDRTGK PIDIPAAFTTGFFR |
| PsiH (from *P. cyanescens*) | 21 | MAPLTTMITILLSLLLAGCIYYINARRVRRS HLPPGPPGIPIPFIGNMFDMPSESPWLTF LQWGRDYQTDILYVDAGGSEMIILNSLEAI TDLLEKRGSIYSGRLESTMVNELMGWEFD LGFITYGERWREERRMFAKEFSEKNIRQFR HAQVQAANRLVRQLIKTPGRWSQHIRHQI AAMSLDIGYGIDLAEDDPWLEATQLANEG LAIASVPGSFWVDSFPSLKYLPSWLPGAGF KRKARVWKEGADHMVNMPYETMKKLSA QGLARPSYASARLQAMDPNGDLEHQEHVI KNTATEVNVGGGDTTVSAMSAFILAMVK YPEVQRKAQAELDMLTSKGLIPDYDEEDD SLPYLTACVKELFRWNQIAPLAIAHRLIKD DVYRGYTIPKNALVFANTWAVLNDPEEYP DPSEFRPERYLGPDGKPDHTVRDPRKAAFG YGRRTCPGLHLAQSTVWIAGATLLSVFNV ERPVDRTGKPIDIPAAFTTGFFR |
| PsiH2 (from *P. cyanescens*) | 22 | MAPLTTMIPIVLSLLIAGCIYYINARRIKRSR LPPGPPGIPIPFIGNMFDMPSESPWLIF LQWGQEYQTDIIYVDAGGTDMIILNSLEAI TDLLEKRGSLYSGRLESTMVNELMGWEFD FGFIPYGERWREERRMFAKEFSEKNIRQFR HAQVKAANQLVRQLTDKPDRWSHHIRHQI ASMALDIGYGIDLAEDDPWIAASELANEGL AVASVPGSFWVDTFPFLKYLPSWLPGAEF KRNAKMWKEGADHMVNMPYETMKKLSA QGLTRPSYASARLQAMDPNGDLEHQERVI KNTATQVNVGGGDTTVGAVSAFILAMVK YPEVQRKVQAELDEFTSKGRIPDYDEDNDS LPYLSACFKELFRWGQIAPLAIAHRLIKDD VYREYTIPKNALVFANNWYGRTVLNDPSE YPNPSEFRPERYLGPDGKPDDTVRDPRKAA FGYGRRVCPGIHLAQSTVWIAGVALVSAF NIELPVDKDGKCIDIPAAFTTGFFR |
| PsiH_tampanensis | 23 | MHTDSIVISLAAGLAVCIHFANSRRLRRAS LPPGPPGIPLPFVGNMEDMPSESPWLKYLQ WGKEYQSDIIYLNAGGTEIIVLNTLEAITDL LEKRGSIYSGRLESTMVNELMGWDFDLGFI TYGERWREERRMFAKEFNEKNIKQFRHAQ IKAANQLVQQLAKTPQRWYQHIRHRIAAM S LDIGYGIDLPEDDPWIAATMLANEGLAEAS VPGSFWVDSFPLLKYIPSWMPGAGFKRKA KIWREGTDHMVDMPYETMKKLHAEGLAR PSYAWARLQAMDPNGDLEHQEHVIRNTST EVNTVSAVSAFILAMVKYPKVQRKIQEELD SVLNRGEIPDFDEENDPLPYLTACVKEVFR WNQIAPLAIAHRLDKDDVYRGYLIPKGAL VFANSWAVLNDPQVYPDPSEFRPERYLDS EGRPDNTVRDPRKAAFGYGRRNCPGIHLA QTTVWIVAATLLQVFNIERPVDANGTPIDIP AAFTTGFFRYDRFTRLCHLSDFS |

TABLE 3-continued

Exemplary polypeptides that can be upregulated, downregulated or expressed by an exogenously introduced gene in a genetically modified organism described herein.

| Name: | SEQ ID NO.: | Sequence: |
|---|---|---|
| xPsiH2 (from *P. tampanensis*) | 24 | MQNGALTVFVAFISAACIYYVHARRARRA SLPPGPRGIPLPFVGNVFDMPSESSWLTFLE WGKQYQSDLIYLNSGGIEMVILNTLETMT DLLEKRGSIYSGRLESTMVNELMGWKFDF GFVTYGERWREERRMFSREFNEKNIKQFR HAQVKALKELVRKLDKDPSRWYQHLRHQ IASMALDIGYGIDLAENDPWIEETILANDAL ALASVPGCYWVDSFPILQYVPSWLPFAGFK RKAKVWKKNTEYMVNVLYETMKRQTVQ GLTRPSYASARLQAMAPDINLEHQERVIKN SASQVITVSALAAFILAMVKYPNVQRKVQ AELDAIASQNEIPDFDEENGTMPYLTACLK EVFRWNQIAPLGIAHRLDKDDSYRGYLIPK GTLVFANIWAILNDPLMYPNPGEFQPERYL GPDGKHDPSVRDPRKIAFGWGRRACPGIY LAQSTVWHTATNLLSAFNIEPPLNEEGKPI KVEAAFTTGFFRYSPRSDA |
| PsiH2 (from *P. azurescens*) | 25 | MITIVLSLLIAGCVYYTNARRIKRSSLPPGPP GIPIPFIGNMFDMPSESPWLTFLQWGQE YQTDIIYVDAGGSDMIILNSLEAITNLLEKR GSLYSGRLESTMVNELMGWEFDFGFIPYG ERWREERRMFAKEFTEKNIRQFRHAQVKA ANQLVRQLTDKPDRWSHHIRHQIASMALD IGYGIDLAEDDPWIAASELANEGLAVASVP GSFWVDTFPPFLKYIPSWLPGAEFKRNAKV WKEGADHMVNMPYERMKKLSAQGLTRPS YASARLQAMDPNGDLEHQERVIKNTATQV NVGGGDTTVGAVSAFILAMVKYPEVQRK VQAELDEFTSKGRIPDYDEDNDSLPYLSAC FKELFRWGQIAPLAIAHRLIKDDVYREYTIP KNALVFANNWTVLNDPSEYPNPSEFRPER YLGPDGKPDDTVRDPRKAAFGYGRRVCPG IHLAQSTVWIAGVALVSAFNIELPVDKDGK CIDIPAAFTTGFFR |
| PsiK | 26 | MTFDLKTEEGLLSYLTKHLSLDVAPNGVK RLSGGFVNVTWRVGLNAPYHGHTSIILKH AQPHLSSDIDFKIGVERSAYEYQALKIVSA NSSLLGSSDIRVSVPEGLHYDVVNNALIMQ DVGTMKTLLDYVTAKPPISAEIASLVGSQI GAFIARLHNLGRENKDKDDFKFFSGNIVGR TTADQLYQTIIPNAAKYGIDDPILPIVVKEL VEEVMNSEETLIMADLWSGNILLQFDENST ELTRIWLVDWELCKYGPPSLDMGYFLGDC FLVARFQDQLVGTSMRQAYLKSYARNVK EPINYAKATAGIGAHLVMWTDFMKWGND EEREEFVKKGVEAFHEANEDNRNGEITSIL VKEASRT |
| PsiM | 27 | MHIRNPYRTPIDYQALSEAFPPLKPFVSVN ADGTSSVDLTIPEAQRAFTAALLHRDFGLT MTIPEDRLCPTVPNRLNYVLWIEDIFNYTN KTLGLSDDRPIKGVDIGTGASAIYPMLACA RFKAWSMVGTEVERKCIDTARLNVVANN LQDRLSILETSIDGPILVPIFEATEEYEYEFT MCNPPFYDGAADMQTSDAAKGFGFGVGA PHSGTVIEMSTEGGESAFVAQMVRESLKLR TRCRWYTSNLGKLKSLKEIVGLLKELEISN YAINEYVQGSTRRYAVAWSFTDIQLPEELS RPSNPELSSLF |
| PsiR (from *P. cubensis*) | 28 | MAPATPATHDPALSHGAPPAPGAPAPANA PPNASGDIAGMQLSGLDQSQIMNLLRSLPG MFSGGKIPDQGQGNKEDAAQTLSNLAQAQ PYGQQLPLHYQAGGPGGLPGINDPGPSTHP RGPPNLGQLSAVAMQAAPAPIQHPDQQTN RNDGEQAGNASASTSGKDGDNAEFVPPPA PAPTTGRRGGRSATMGSDEWSRQRKDNH KEVERRRRGNINEGINELGRIVPSGSGEKA KGAILSRAVQYIHHLKENEARNIEKWTLEK LLMDQAMGDLQAQLEEVKRLWEEERMAR TRLEAELEVLRNMNGVNAGSAPASKDESA |

TABLE 3-continued

Exemplary polypeptides that can be upregulated, downregulated or expressed by an exogenously introduced gene in a genetically modified organism described herein.

| Name: | SEQ ID NO.: | Sequence: |
|---|---|---|
| | | AGTKRRSTDGAEAATAATESSTANAEGER<br>DGKRQRTE |
| TrpE<br>(anthranilate<br>synthase from<br>E. Coli) | 100 | MQTQKPTLELLTCEGAYRDNPTALFHQLC<br>GDRPATLLLESADIDSKDDLKSLLLVDSAL<br>RITALGDTVTIQALSGNGEALLALLDNALP<br>AGVESEQSPNCRVLRFPPVSPLLDEDARLC<br>SLSVFDAFRLLQNLLNVPKEEREAMFFGGL<br>FSYDLVAGFEDLPQLSAENNCPDFCFYLAE<br>TLMVIDHQKKSTRIQASLFAPNEEEKQRLT<br>ARLNELRQQLTEAAPPLPVVSVPHMRCEC<br>NQSDEEFGGVVRLLQKAIRAGEIFQVVPSR<br>RFSLPCPSPLAAYYVLKKSNPSPYMFFMQD<br>NDFTLFGASPESSLKYDATSRQIEIYPIAGT<br>RPRGRRADGSLDRDLDSRIELEMRTDHKEL<br>SEHLMLVDLARNDLARICTPGSRYVADLT<br>KVDRYSYVMHLVSRVVGELRHDLDALHA<br>YRACMNMGTLSGAPKVRAMQLIAEAEGR<br>RRGSYGGAVGYFTAHGDLDTCIVIRSALVE<br>NGIATVQAGAGVVLDSVPQSEADETRNKA<br>RAVLRAIATAHHAQETF |
| PsiL (P.<br>Cubensis) | 161 | MNFLLSIATLGLGLQAYAVMIGPSATLVIG<br>NKNIAPDGIKRSAV<br>LAGTSLDTLSFPGPVIRATKGDTLSLNVVN<br>QLTDATMLMGTSIHWHGFHQKGTSWADG<br>VVGVTQCPIAPGHSFLYQFPTANQAGTFW<br>YHSHYSTQYCDGLRGALIVYDPTDPYRTW<br>YDIDDESTIITLADWYHKAAPLQTLRTAKE<br>DSVLINGQGRVPGDKTTDSTPLSVINII<br>PQKRYRFRLISISCDPAFSFSIDGHSMTVIEA<br>DSQSVQPLTVNEITIFAGQRYSFILY<br>ANNPVGNYWIRSQPTYPDDGIQGYAGGIN<br>SAILRYSGAPAVNPTTKKASITIPLVEAD<br>LRPLYSPAAPGLPSPGAADVNIKLDISYNSP<br>SETFFVNNSTFPEVPVPVLLQILSGAQ<br>SANDLLPAGSVYTLPPNKVIEISMPGGRPGS<br>PHPMHLHGHDFSVVRSAGSNRYNYANP<br>VRRDVVNIGMEDTDNVTIRFKTDNSGPWIL<br>HCHIDWHIEAGLAVVFTEDIPSIQFSNP<br>PPAWDQLCPIFNAIPPQKFH |

Methods of Making Genetic Modifications

This disclosure provides systems, compositions, and methods for genetically modifying a cell of an organism so as to produce one or more desirable alkaloids. An exemplary cell includes a fungal cell, such as a fungal protoplast. In some embodiments, the genetic modification is produced using a gene editing system.

A gene editing (also called genome editing) system refers to a group of technologies that give the ability to change an organism's DNA. Many genome editing systems are based on bacterial nucleases. The systems, compositions, and methods described herein take advantage of genome editing systems to make targeted edits in an organism's genome and thereby produce one or more alkaloids that are of interest. To that end, the genome editing systems as used herein can possess programmable nucleases. In some embodiments, the genome editing system comprises a zinc-finger nuclease (ZFN). A zinc finger nuclease is an artificial endonuclease that can comprise a designed zinc finger protein (ZFP) fused to a cleavage domain, such as, a FokI restriction enzyme. In some embodiments, the genome editing system comprises a transcription activator-like effector nuclease (TALEN). TALENs are restriction enzymes that can be engineered to cut specific sequences of DNA. They are made by fusing a TAL effector DNA-binding domain to a DNA cleavage domain (a nuclease which cuts DNA strands). Transcription activator-like effectors (TALEs) can be engineered to bind to practically any desired DNA sequence, so when combined with a nuclease, DNA can be cut at specific locations. In some embodiments, the genome editing system is a meganuclease. In some embodiments, a gene editing system is used in incorporate an exogenous nucleic acid into a fungal, wherein incorporation of the exogenous nucleic acid results in a genetic modification that modulates production of an alkaloid. In some embodiments, the exogenous nucleic acid comprises a sequence that is at least: 50%, 55%, 60%, 65%, 70%, 75%, 80%, 85%, 90%, 95%, 99%, or is 100% identical to one of the sequences listed in TABLE 2. In some embodiments, the nucleic acid comprises a sequence comprising a sequence selected from the group consisting of: SEQ ID NOs. 1-19, 67, 90-99, and 151. In some embodiments, the gene editing system is a CRISPR system, such as the CRISPR-Cas9 endonuclease system.

CRISPR (clustered regularly interspaced short palindromic repeats) can refer to a family of DNA repeats found in certain bacterial genomes.

In some embodiments, the guide RNA binds to a gene comprising a target sequence shown in TABLES 9-16, and SEQ ID NOS: 29-87. In some embodiments, the guide RNA binds to a gene comprising a target sequence shown in TABLES 9-16, and SEQ ID NOS: 29-87. In some embodiments, the guide RNA within about 100 bases, about 75 bases, about 50 bases, about 25 bases, about 5 bases, or 1 base of the sequence comprising one of SEQ ID NOS: 29-87. In some embodiments, the guide RNA binds to the gene at a loci at least partially overlapping the sequence comprising one of SEQ ID NOS: 29-87. In some embodiments, the at least one guide polynucleotide comprises a targeting sequence that is complementary to one of SEQ ID NOS: 29-87. In some embodiments, the at least one guide polynucleotide comprises a targeting sequence that binds to one of SEQ ID NOS: 29-87.

The recognition of a target DNA target region can depend on a protospacer adjacent motif (PAM) which can be located at the 3'-terminus of a 20 bp target sequence, e.g., see TABLES 1-9. Once the CRISPR complex (e.g., Cas9 and associated guide RNA) recognizes the target DNA sequence, the CRISPR complex can generate a double strand break (DSB) at the DNA target locus. In some instances, one of two cellular DNA repair mechanisms, non-homologous end joining (NHEJ) and homologous recombination (HR), can play a role in precise genome editing and gene manipulation. For example, NHEJ, which is sometimes regarded as an error-prone repair mechanism that generates either short insertions or deletions of nucleotides in close proximity to the DSB site(s), can be used. If these short insertions or deletions exist in a gene coding region, or within a portion of the promoter involved in recruiting proteins involved in transcription, the function of the endogenous gene, for example a gene encoding psilocybin phosphatase, can be disrupted. Consequently, this procedure can be used for generating gene mutations. In other embodiments, a homology independent targeted integration (HITI) strategy can be used which allows fragments (e.g., exogenous nucleic acids) to be integrated into the genome by NHEJ repair.

Various versions of CRISPR systems can be used. In some instances, the CRISPR system can be introduced into the genome of a target organism using *Agrobacterium tumefaciens*-mediated transformation. When the expression of Cas protein and guide RNA can be under the control of either a constitutive or inducible promoter. For example, in some embodiments, the Cas protein is under the control of a GDP gene protomer, while the guide RNA is under the control of a U6 gene promoter. In some embodiments, the guide RNA is inserted directly downstream of a *P. cubensis* U6 promoter and directly upstream of the guide RNA scaffold sequence. In some instances, the Cas protein is optimized for use in a fungal cell.

In some embodiments, an endonuclease system that is used to genetically modified an organism described herein comprises a CRISPR enzyme and a guide nucleic acid that hybridizes with a target sequence in, or adjacent to the gene or the promoter or enhancer associated therewith. In some cases, a target sequence can be at least 18 nucleotides, at least 19 nucleotides, at least 20 nucleotides, at least 21 nucleotides, or at least 22 nucleotides in length.

A CRISPR enzyme can direct cleavage of one or both strands at a target sequence, such as within a target sequence and/or within a complement of a target sequence. In some embodiments, a target sequence is at least about 18 nucleotides, at least 19 nucleotides, at least 20 nucleotides, at least 21 nucleotides, or at least 22 nucleotides in length. In some embodiments, a target sequence is at most 17 nucleotides in length. In some aspects, a target can be selected from a sequence comprising homology from about 50%, 60%, 70%, 80%, 90%, 95%, 96%, 97%, 98%, 99%, or up to about 100% to any one of: SEQ ID NOS: 1 to 18, or 89-99. In some embodiments, the target is a psilocybin synthase gene. In some aspects, a target can be selected from a sequence comprising homology from about 50%, 60%, 70%, 80%, 90%, 95%, 96%, 97%, 98%, 99%, or up to about 100% to any one of: SEQ ID NOS: 1 to 19, or 89-99. In some embodiments, the target is a psilocybin synthase gene.

The CRISPR enzyme can be guided by a guide polynucleotide, which can be DNA or RNA. A guide polynucleotide acid can be single stranded or double stranded. In some cases, a guide polynucleotide contains regions of single stranded areas and double stranded areas. guide polynucleotide can also form secondary structures. As used herein, the term "guide RNA (gRNA)," and its grammatical equivalents can refer to an RNA which can be specific for a target DNA and can form a complex with a Cas protein. A guide RNA can comprise a guide sequence, or spacer sequence, that specifies a target site and guides an RNA/Cas complex to a specified target DNA for cleavage. For example, a guide RNA can target a CRISPR complex to a target gene or portion thereof and perform a targeted double strand break. The target gene can be a gene listed in TABLES 1 and 2. Site-specific cleavage of a target DNA occurs at locations determined by both 1) base-pairing complementarity between a guide RNA and a target DNA (also called a protospacer) and 2) a short motif in a target DNA referred to as a protospacer adjacent motif (PAM). In some cases, gRNAs can be designed using an algorithm which can identify gRNAs located in early exons within commonly expressed transcripts.

A CRISPR system can comprise a nucleic acid-binding domain, e.g., a guide polynucleotide. The nucleic acid-binding domain can comprise a region that contacts a nucleic acid. A nucleic acid-binding domain can comprise a nucleic acid. A nucleic acid-binding domain can comprise DNA. A nucleic acid-binding domain can comprise single stranded DNA. Examples of nucleic acid-binding domains can include, but are not limited to, a helix-turn-helix domain, a zinc finger domain, a leucine zipper (bZIP) domain, a winged helix domain, a winged helix turn helix domain, a helix-loop-helix domain, an HMG-box domain, a Wor3 domain, an immunoglobulin domain, a B3 domain, and a TALE domain. A nucleic acid-binding domain can be a domain of a CRISPR system protein. A CRISPR system protein can be a eukaryotic CRISPR system or a prokaryotic CRISPR. A CRISPR system protein can bind RNA or DNA, or both RNA and DNA. In some embodiments, a CRISPR system protein binds a DNA and cleaves the DNA. In some instances, the CRISPR system protein binds a double-stranded DNA and cleaves a double-stranded DNA. In some instances, two or more nucleic acid-binding domains can be linked together. Linking a plurality of nucleic acid-binding domains together can provide increased polynucleotide targeting specificity. Two or more nucleic acid-binding domains can be linked via one or more linkers. The linker can be a flexible linker. Linkers can comprise 1, 2, 3, 4, 5, 6, 7, 8, 9, 10, 11, 12, 13, 14, 15, 16, 17, 18, 19, 20, 21, 22, 23, 24, 25, 30, 35, 40 or more amino acids in length. The linker domain may comprise glycine and/or serine, and in some embodiments may consist of or may consist essentially of glycine and/or serine. Linkers can be a nucleic acid linker which can comprise nucleotides. A nucleic acid linker can link two DNA-binding domains together. A nucleic acid linker can be at most 5, 10, 15, 20, 25, 30, 35, 40, 45, or 50 or more nucleotides in length. A nucleic acid linker can be at least 5, 10, 15, 30, 35, 40, 45, or 50 or more nucleotides in length. Nucleic acid-binding domains can bind to nucleic acid sequences. Nucleic acid binding domains can bind to nucleic acids through hybridization. Nucleic acid-binding domains can be engineered (e.g., engineered to hybridize to a sequence in a genome). A nucleic acid-binding domain can be engineered by molecular cloning techniques (e.g., directed evolution, site-specific mutation, and rational mutagenesis). A CRISPR system can comprise a nucleic acid-cleaving domain. The nucleic acid-cleaving domain can be a nucleic acid-cleaving domain from any nucleic acid-cleaving protein. The nucleic acid-cleaving domain can originate from a nuclease. Suitable nucleic acid-cleaving domains include the nucleic acid-cleaving domain of endonucleases (e.g., AP endonuclease, RecBCD endonuclease, T7 endonuclease, T4 endonuclease IV, Bal 31 endonuclease, EndonucleaseI (endo I), Micrococcal nuclease, Endonuclease II (endo VI, exo III)), exonucleases, restriction nucleases, endoribonucleases, exoribonucleases, RNases (e.g., RNAse I, II, or III). A nucleic acid-binding domain can be a domain of a CRISPR system protein. A CRISPR system protein can be a eukaryotic CRISPR system or a prokaryotic CRISPR/CasX. A CRISPR system protein can bind RNA or DNA, or both RNA and DNA. A CRISPR system protein can cleave RNA, or DNA, or both RNA and DNA. In some embodiments, a CRISPR system protein binds a DNA and cleaves the DNA. In some embodiments, the CRISPR system protein binds a double-stranded DNA and cleaves a double-stranded DNA. In some embodiments, the nucleic acid-cleaving domain can originate from the FokI endonuclease.

A CRISPR system can comprise a plurality of nucleic acid-cleaving domains. Nucleic acid-cleaving domains can be linked together. Two or more nucleic acid-cleaving domains can be linked via a linker. In some embodiments, the linker can be a flexible linker as described herein. Linkers can comprise 1, 2, 3, 4, 5, 6, 7, 8, 9, 10, 11, 12, 13, 14, 15, 16, 17, 18, 19, 20, 21, 22, 23, 24, 25, 30, 35, 40 or more amino acids in length. In some embodiments, a CRISPR system can comprise the plurality of nucleic acid-cleaving domains. CRISPR system can introduce double-stranded breaks in nucleic acid, (e.g., genomic DNA). The double-stranded break can stimulate a cell's endogenous DNA-repair pathways (e.g., homologous recombination and non-homologous end joining (NHEJ) or alternative nonhomologues end joining (A-NHEJ)). NHEJ can repair cleaved target nucleic acid without the need for a homologous template. This can result in deletions of the target nucleic acid. Homologous recombination (HR) can occur with a homologous template. The homologous template can comprise sequences that are homologous to sequences flanking the target nucleic acid cleavage site. After a target nucleic acid is cleaved by a CRISPR system the site of cleavage can be destroyed (e.g., the site may not be accessible for another round of cleavage with the original nucleic acid targeting nucleic acid and CRISPR/Cas9).

This disclosure provides methods for genetically modifying an organism for increased production of one or more alkaloids. In some embodiments, a genetic modification is accomplished by introducing an exogenous nucleic acid, e.g., a donor sequence, into a cell of the organism. Exemplary cells of the organisms include a fungal cell. Exemplary fungal cells include a protoplast. The exogenous nucleic acid may encode one or more gene products that, when expressed by the genetically modified organism, result in the genetically modified organism producing an increased amount of the one or more alkaloids as compared to a comparable wild-type organism. In some instances, the one or more genes can be one of the genes listed in TABLE 1 or TABLE 2. In some embodiments, the one or more genes can comprise one of the genes selected from the group consisting of SEQ ID NOs: 1-19, 67, 90-99, and 151. In some embodiments, the one or more genes can comprise one of the genes has 95% percent identity to a sequence selected from the group consisting of SEQ ID NOs: 1-19, 67, 90-99, and 151. In some instances, one or more copies of the one or more genes included in TABLE 1 or TABLE 2 are provided by the exogenous nucleic acid. For example, in some instances at least 1, 2, 3, 4, 5, 6, or 7 copies of the one or more genes are introduced into the genetically modified organism with the exogenous nucleic acid. In some cases, at least a portion of the exogenous nucleic acid can be integrated into the genome of the organism. In some embodiments, the genetic modification results in the genetically modified organism expressing one or more of the polynucleotides listed in TABLE 2. In some embodiments, the genetic modification results in the genetically modified organism expressing one or more of the polynucleotides listed in TABLE 2. In some embodiments, the genetic modification results in the genetically modified organism expressing one or more of the polynucleotides selected from the group consisting of SEQ ID NOs: 1-19, 67, 90-99, and 151. In some embodiments, the genetic modification results in the genetically modified organism expressing one or more of the polynucleotides selected from the group consisting of SEQ ID NOs: 1-19, 67, 90-99, and 151. For example, the exogenous nucleic acid can be inserted into a genomic break. In some instances, at least a portion of the exogenous nucleic acid includes sequences that are homologous to sequences flanking a target sequence for targeted integration. Methods of introducing an exogenous nucleic acid into a cell of an organism are generally known to the skilled artisan but may include the use of homology arms. In other instances, the exogenous nucleic acid can be randomly inserted into a genome of a target organism.

In some embodiments, an exogenous nucleic acid can be integrated to the genome of the genetically modified organism by virtue of homologous recombination. Homologous recombination permits site specific modifications in endogenous genes and thus inherited or acquired mutations may be corrected, and/or novel alterations may be engineered into the genome of the genetically modified organism.

In some embodiments, the exogenous nucleic acid includes a promoter sequence. Increasing expression of designed gene products may be achieved by synthetically increasing expression by modulating promoter regions or inserting stronger promoters upstream of desired gene sequences. In some embodiments, for example, a gene promoter such as 35S gene promoter is used.

In some embodiments, the exogenous nucleic acid can include a barcode or watermark sequence, which may be referred to as "a barcode". A barcode can comprise a non-natural sequence. In some embodiments, the barcode can be used to identify transgenic organisms via genotyping. In some embodiments, the exogenous nucleic acid can include a selectable marker, such as an antibiotic resistance gene. Selectable marker genes Selectable marker genes, also referred to herein as "selection markers," can include, for example, a hygromycin resistance gene.

In some embodiments, a unique sequence is embedded into the genome of a genetically modified organism described herein using CRISPR methods for identification purposes. In some embodiments, this is referred to as a marker or marker sequence. In some embodiments this is referred to as a watermark sequence. In some embodiments, this is referred to as an intergenic sequence, or a portion thereof. In some embodiments, this is referred to as an intergenic watermark sequence. In some embodiments, this is referred to as barcoding. In some cases, the exogenous nucleic acid can include a barcode. The unique sequence is embedded into the genome of a genetically modified organism described herein using CRISPR methods for identification purposes. In some embodiments, this is referred to as a marker or marker sequence. In some embodiments this is referred to as a watermark sequence. In some embodiments, this is referred to as an intergenic sequence, or a portion thereof. In some embodiments, this is referred to as an intergenic watermark sequence. In some embodiments, this is referred to as barcoding. A barcode can comprise a non-natural sequence. In some embodiments, the barcode can be used to identify transgenic organisms via genotyping. In some embodiments, the exogenous nucleic acid can include a selectable marker, such as an antibiotic resistance gene. Selectable marker genes can include, for example, a hygromycin resistance gene. In some embodiments, this can be accomplished using resistance vector gene sequences like those shown in Table 4A. Exemplary terminator sequences are shown in TABLE 4A and TABLE 4B. In some embodiments, the terminator sequence comprises a sequence selected from the group consisting of any one of SEQ TD NOs: 303, and 460-462. In some embodiments, the terminator sequence comprises a sequence with 95% identity to selected from the group consisting of any one of SEQ ID NOs: 303, and 460-462. In some embodiments, the terminator sequence is a sequence selected from the group consisting of any one of SEQ ID NOs: 303, and 460-462.

TABLE 4A

Resistance vector and related gene sequences

| SEQ ID NO. | Sequence type | Sequence |
|---|---|---|
| 205 | 35S promoter | TGAGACTTTTCAACAAAGGG TAATATCGGGAAACCTCCTC GGATTCCATTGCCCAGCTAT CTGTCACTTCATCAAAAGGA CAGTAGAAAAGGAAGGTGGC ACCTACAAATGCCATCATTG CGATAAAGGAAAGGCTATCG TTCAAGATGCCTCTGCCGAC AGTGGTCCCAAAGATGGACC CCCACCCACGAGGAGCATCG TGGAAAAGAAGACGTTCCA ACCACGTCTTCAAAGCAAGT GGATTGATGTGATAACATGG TGGAGCACGACACTCTCGTC TACTCCAAGAATATCAAAGA TACAGTCTCAGAAGACCAAA GGGCTATTGAGACTTTTCAA CAAAGGGTAATATCGGGAAA CCTCCTCGGATTCCATTGCC CAGCTATCTGTCACTTCATC AAAAGGACAGTAGAAAAGGA AGGTGCACCTACAAATGCC ATCATTGCGATAAAGGAAAG GCTATCGTTCAAGATGCCTC TGCCGACAGTGGTCCCAAAG ATGGACCCCCACCCACGAGG AGCATCGTGGAAAAAGAAGA CGTTCCAACCACGTCTTCAA AGCAAGTGGATTGATGTGAT ATCTCCACTGACGTAAGGGA TGACGCACAATCCCACTATC CTTCGCAAGACCTTCCTCTA TATAAGGAAGTTCATTTCAT TTGGGAGAGGACACGCTGAAA TCACCAGTCTCTCTCTACAA ATCTATCTCTCTCGAGCTTT CGCAGATCCCGGGGGCAAT GAGAT |

TABLE 4A-continued

Resistance vector and related gene sequences

| SEQ ID NO. | Sequence type | Sequence |
|---|---|---|
| 302 | Hygromycin resistance | ATGAAAAAGCCTGAACTCAC CGCGACGTCTGTCGAGAAGT TTCTGATCGAAAAGTTCGAC AGCGTCTCCGACCTGATGCA GCTCTCGGAGGGCGAAGAAT CTCGTGCTTTCAGCTTCGAT GTAGGAGGGCGTGGATATGT CCTGCGGGTAAATAGCTGCG CCGATGGTTTCTACAAAGAT CGTTATGTTTATCGGCACTT TGCATCGGCCGCGCTCCCGA TTCCGGAAGTGCTTGACATT GGGGAGTTTAGCGAGAGCCT GACCTATTGCATCTCCCGCC GTGCACAGGGTGTCACGTTG CAAGACCTGCCTGAAACCGA ACTGCCCGCTGTTCTACAAC CGGTCGCGGAGGCTATGGAT GCGATCGCTGCGGCCGATCT TAGCCAGACGAGCGGGTTCG GCCCATTCGGACCGCAAGGA ATCGGTCAATACACTACATG GCGTGATTTCATATGCGCGA TTGCTGATCCCCATGTGTAT CACTGGCAAACTGTGATGGA CGACACCGTCAGTGCGTCCG TCGCGCAGGCTCTCGATGAG CTGATGCTTTGGGCCGAGGA CTGCCCCGAAGTCCGGCACC TCGTGCACGCGGATTTCGGC TCCAACAATGTCCTGACGGA CAATGGCCGCATAACAGCGG TCATTGACTGGAGCGAGGCG ATGTTCGGGGATTCCCAATA CGAGGTCGCCAACATCTTCT TCTGGAGGCCGTGGTTGGCT TGTATGGAGCAGCAGACGCG CTACTTCGAGCGGAGGCATC CGGAGCTTGCAGGATCGCCA CGACTCCGGGCGTATATGCT CCGCATTGGTCTTGACCAAC TCTATCAGAGCTTGGTTGAC GGCAATTTCGATGATGCAGC TTGGGCGCAGGGTCGATGCG ACGCAATCGTCCGATCCGGA GCCGGGACTGTCGGGCGTAC ACAAATCGCCCGCAGAAGCG CGGCCGTCTGGACCGATGGC TGTGTAGAAGTACTCGCCGA TAGTGGAAACCGACGCCCCA GCACTCGTCCGAGGGCAAAG AAATAG |
| 193 | 35S terminator | AGTAGATGCCGACCGGATCT GTCGATCGACAAGCTCGAGT TTCTCCATAATAATGTGTGA GTAGTTCCCAGATAAGGGAA TTAGGGTTCCTATAGGGTTT CGCTCATGTGTTGAGCATAT AAGAAACCCTTAGTATGTAT TTGTATTTGTAAAATACTTC TATCAATAAAATTTCTAATT CCTAAAACCAAAATCCAGTA CTAAAATCCAGATC |

TABLE 4B

Exemplary Terminator Sequences

| SEQ ID NO | Name | Sequence |
|---|---|---|
| 460 | GDP terminator | ATAGTTGCTTGAATGCGCCG CCCGTCAAAAAGAAAATCG AACTTTTTATAGTGTAATGG TATCAAGTTTAGAATATGTG CTGTTCTGTGATTTCATTTC TGTTTAGAAGTGCGTTAAGG GATGATATATTGATACATTG ATGGATGTCAGAAATGCATG AATCAATGTGCTTTTTTGAA TGGCGTGAAGTTTTTCAGTA CCCGGGACCTGGCCATGGGC CATGGCATGGACTCGGAGAT CCGACAGAAAGTCACGGGAG TGTTGTGTGTAGTCACGTGA GCAACGCGAGCGACGCGGTT GACGGGCGTCCATTTTTGAC TTTCTTGTTCTCATCACACT CCAACCATCTTCTTCCATCG CCGTTGCCTCCCCTTTTTTT ACCCGACTTTTCCTGGCAGA CTTTGAACTATTTGAACCAG GATGTGGGCAAAGTTCAGTT CCGCATTGAAATCGACAACG ACGAGGCCTCAAGAGCCTGA AGAGACAAGATCCACAACAC CGGTGCATTTTGGTCCGTCG CGGGCTGAAACACCGCAGAG TATCGGGCGTAGCCAGGCAG AAGTTACCGCTCACTTACTG GGAGAAAGTAGTTCTGACTC GACTGCTTT |
| 461 | CNOT terminator | AAAAAAATTTGATTGTGTAC ACTAACACTTTTCCTATTCG CTCAGGTGGCACGATCGATT TTCCAACAGTAGAAAGCTTT GTCGTTATAATTCTCGCTAT CTTTGCACATATCTGTCATT CCTATCTGGGCTTATTACAC CTGCATACTGTATTGTAACA ACATTACCTTTTTTTATCAC TTTTCGGCTTTCAGATACTT TGTTGTGGCTTTTTTTCTAT TTCAACTTTCACTTTATGCC CTTCTGAATGAACACCTTGT CACTGCTTCTGCAATGTTTC TGTGTGACTGCTCAGTCTCG TGGTCGTGTGACATTCGTGG TGATATGCAGCGTTCGGTTA AGTCGCGACTTGAAGTCCTA CGATAACATTGATTAAATAT GCCTCGCGAGATTGTAACTG TCCAGCTTGGCCAATGTGGA AACCAGAGTACGCTTTCTTG AATATTTGGGATACAATACG CGTCTCATCTCTTGATGATT TTTGATCAAGTGGGCTCGGT TTTTT |
| 462 | trpC terminator (from *Aspergillus nidulans*) | agtagatgccgaccggatct gtcgatcgacaagctcgagc ggccgcagtagatgccgacc gggatccacttaacgttact gaaatcatcaaacagcttga cgaatctggatataagatcg ttggtgtcgatgtcagctcc ggagttgagacaaatggtgt tcaggatctcgataagatac gttcatttgtccaagcagca aagagtgccttctagtgatt taatagctccatgtcaacaa gaataaaacgcgtttcgggt ttacctcttccagatacagc tcatctgcaatgcattaatg cattggacctcgcaaccccta gtacgcccttcaggctccgg cgaagcagaagaatagctta gcagagtctattttcatttt cgggagacgagatcaagcag atcaacggtcgtcaagagac ctacgagactgaggaatccg ctcttggctccacgcgacta tatatttgtctctaattgta ctttgacatgctcctcttct ttactctgatagcttgacta tgaaaattccgtcaccagcc cctgggttcgcaaagataat tgcactgtttcttccttgaa ctctcaagcctacaggacac acattcatcgtaggtataaa cctcgaaaatcattcctact aagatgggtatacaatagta accatgcatggttgcctagt gaatgctccgtaacacccaa tacgccggccgaaacttttt tacaactctcctatgagtcg tttacccagaatgcacaggt acacttgtttagaggtaatc cttctttctagaagtcctcg tgtactgtgtaagcgcccac tccacatctccactcgagct agctag |

In some embodiments, a hygromycin resistance gene is used. In some embodiments, the hygromycin resistance gene sequence is SEQ ID NO.: 302. In some embodiments, the sequence encoding the marker can be incorporated into the genetically modified cell or organism, for instance a fungal cell, yeast cell or plant cell as described herein. In some cases, a marker serves as a selection or screening device may function in a regenerable genetically modified organism to produce a compound that would confer upon a tissue in said organism resistance to an otherwise toxic compound. In some embodiments, the incorporated sequence encoding the marker may by subsequently removed from the transformed genome. Removal of a sequence encoding a marker may be facilitated by the presence of direct repeats before and after the region encoding the marker. In some embodiments, the marker sequence is followed by a protospacer adjacent motif (PAM), in order to provide appropriate cleavage by a Cas nuclease.

In some embodiments, the hygromycin resistance gene sequence is SEQ ID NO. 302.

In some embodiments, a unique sequence is embedded into the genome of a genetically modified organism described herein using gene editing methods such as CRISPR for identification purposes. In some embodiments, this is referred to as a marker or marker sequence. In some embodiments this is referred to as a watermark sequence. In some embodiments, this is referred to as an intergenic sequence, or a portion thereof. In some embodiments, this is referred to as an intergenic watermark sequence. In some embodiments, this is referred to as barcoding as noted above. In some embodiments, the incorporated sequence encoding the marker may by subsequently removed from the transformed genome. Removal of a sequence encoding a marker may be facilitated by the presence of direct repeats before and after the region encoding the marker. In some embodiments, the marker sequence is followed by a protospacer adjacent motif (PAM), in order to provide appropriate cleavage by a Cas nuclease.

In some embodiments, the exogenous nucleic acid can be introduced into the genetically modified organism by transformation or transfection.

Following transformation, fungi or other organisms can be selected using a dominant selectable marker incorporated into, for example, the transformation vector. In certain embodiments, such marker confers antibiotic or herbicide resistance on the transformed fungi or other organisms, and selection of transformants can be accomplished by exposing the fungi and other organisms to appropriate concentrations of the antibiotic or herbicide. In some embodiments, a ccdb negative selection marker is used. In some embodiments the ccdb negative selection marker is prepared by transforming a ccdb sensitive *E. coli* strain, e.g., DH5a. After transformed fungi or other organisms are selected and grown to maturity, those fungi and other organisms showing a modified trait are identified. The modified trait can be any of those traits described above. Additionally, expression levels or activity of the polypeptide or polynucleotide described herein can be determined by analyzing mRNA expression, using Northern blots, RT-PCR, RNA seq or microarrays, or protein expression using immunoblots or Western blots or gel shift assays.

Suitable methods for transformation of fungal or other cells for use with the current disclosure can include virtually any method by which a nucleic acid can be introduced into a cell, such as by direct delivery of DNA such as by PEG-mediated transformation of protoplasts, by desiccation/inhibition-mediated DNA uptake, by electroporation, by agitation with silicon carbide fibers, by *Agrobacterium*-mediated transformation and by acceleration of DNA coated particles. Through the application of techniques such as these, the cells of virtually any fungus species may be stably transformed, and these cells developed into transgenic fungi.

*Agrobacterium*-Mediated Transformation

*Agrobacterium*-mediated transfer can be used to introduce an exogenous nucleic acid into an organism selected for genetic modification, such as a fungal cell. In some instances, the exogenous nucleic acid can be introduced into whole fungal tissues, thereby by passing the need for regeneration of an intact fungus from a protoplast. The use of *agrobacterium*-mediated transformation can be used to integrate one or more vectors into the genetically modified organisms, including vectors or sequences encoding gene-editing systems, such as CRISPR systems or donor sequences.

This disclosure includes advances in vectors for *agrobacterium*-mediated gene transfer by providing improved the arrangement of genes and restriction on sites in the vectors to facilitate the construction of vectors capable of expressing various polypeptide coding genes. In some embodiments, a vector can have convenient multi-linker regions flanked by a promoter and a polyadenylation site for direct expression of inserted polypeptide coding genes and are suitable for purposes described herein. In addition, *Agrobacterium* containing both armed and disarmed Ti genes can be used for the transformations.

In some embodiments, a fungal cell, yeast cell, plant cell, may be modified using electroporation. To effect transformation by electroporation, one may employ either friable tissues, such as a suspension culture of cells or embryogenic callus or alternatively one may transform immature embryos or other organized tissue directly. In some cases, electroporation may comprise 2 pulses, 3 pulses, 4 pulses, 5 pulses 6 pulses, 7 pulses, 8 pulses, 9 pulses, or 10 or more pulses. In some embodiments, protoplasts of fungi and/or plants may be used for electroporation transformation.

Another method for delivering or transforming DNA segments to fungal cells and cells derived from other organisms in accordance with the invention is microprojectile bombardment. In this method, particles may be coated with nucleic acids and delivered into cells by a propelling force. Exemplary particles include those comprised of tungsten, platinum, and preferably, gold. It is contemplated that in some instances DNA precipitation onto metal particles would not be necessary for DNA delivery to a recipient cell using microprojectile bombardment. However, it is contemplated that particles may contain DNA rather than be coated with DNA. In some embodiments, DNA-coated particles may increase the level of DNA delivery via particle bombardment. For the bombardment, cells in suspension are concentrated on filters or solid culture medium. Alternatively, immature embryos or other target cells may be arranged on solid culture medium. The cells that can be bombarded are positioned at an appropriate distance below the macroprojectile stopping plate. In some cases, a starting cell density for genomic editing may be varied to optimize editing efficiency and/or cell viability.

In some embodiments, fungi, yeast or plants of the present disclosure can be used to produce new plant varieties. In some embodiments, the plants are used to develop new, unique and superior varieties or hybrids with desired phenotypes. In some embodiments, selection methods, e.g., molecular marker assisted selection, can be combined with breeding methods to accelerate the process. In some embodiments, a method comprises (i) crossing any organism provided herein comprising the expression cassette as a donor to a recipient organism line to create a FI population, (ii) selecting offspring that have expression cassette. Optionally, the offspring can be further selected by testing the expression of the gene of interest. In some embodiments, complete chromosomes of a donor organism are transferred. For example, the transgenic organism with an expression cassette can serve as a male or female parent in a cross pollination to produce offspring by receiving a transgene from a donor thereby generating offspring having an expression cassette. In a method for producing organisms having the expression cassette, protoplast fusion can also be used for the transfer of the transgene from a donor to a recipient. Protoplast fusion is an induced or spontaneous union, such as a somatic hybridization, between two or more protoplasts (cells in which the cell walls are removed by enzymatic treatment) to produce a single bi- or multi-nucleate cell. In some embodiments, mass selection can be utilized. In mass selection, desirable individual plants are chosen, harvested, and the seed composited without progeny testing to produce the following generation. Since selection is based on the maternal parent only, and there is no control over pollination, mass selection amounts to a form of random mating with selection. As stated herein, the purpose of mass selection is to increase the proportion of superior genotypes in the population.

This disclosure provides gene editing systems for genetically modifying organisms. The gene editing system can be selected form the group consisting of a CRISPR system, TALEN, Zinc Finger, transposon-based, ZEN, meganuclease, Mega-TAL, and any combination thereof. In some embodiments, the gene editing system is directed to a target of interest by a guide polynucleotide. In some embodiments, the gene editing system involves an endonuclease or a nuclease or a polypeptide encoding a nuclease can be from a CRISPR (clustered regularly interspaced short palindromic repeats) system. An endonuclease or a nuclease or a polypeptide encoding a nuclease can be a Cas or a polypeptide encoding a Cas.

In some embodiments, this disclosure provides a genetic modification can involve introducing an exogenous nucleic acid into an organism and/or performing a gene deletion/disruption in the organism. In some instances, this can be accomplished using homologous recombination (HR), wherein selective markers conferring resistance to, for example, an antifungal compound, e.g., hygromycin or neomycin, can be used to replace or integrate within the target locus. While some fungi, e.g., *Saccharomyces cerevisiae*, may have a relatively high HR efficiency, gene disruption can be difficult for many other fungal organisms due to a low HR efficiency. Provided here are efficient, rapid, powerful, and economical gene manipulation tools such as CRISPR technology, which as described in certain embodiments herein, is optimized for use on fungal organisms. This technology can be used to enhance the efficiency of gene manipulation and integration of, for example, one or more exogenous nucleic acids into a fungal cell.

In some embodiments, homologous recombination can insert an exogenous polynucleotide sequence into the target nucleic acid cleavage site. In some embodiments, the exogenous polynucleotide can comprise any sequence of TABLE 2. In some embodiments, the exogenous polynucleotide comprises a sequence selected from the group consisting of: SEQ ID NOs. 1-19, 67, 90-99, and 151. In some embodiments, the exogenous polynucleotide comprises a sequence with 95% identity to sequence selected from the group consisting of: SEQ ID NOs. 1-19, 67, 90-99, and 151. An exogenous polynucleotide sequence can be called a donor polynucleotide or a donor sequence. In some embodiments of compositions and methods of the disclosure, the donor polynucleotide, a portion of the donor polynucleotide, a copy of the donor polynucleotide, or a portion of a copy of the donor polynucleotide can be inserted into the target nucleic acid cleavage site. A donor polynucleotide can be an exogenous polynucleotide sequence. A donor polynucleotide can be a sequence that does not naturally occur at the target nucleic acid cleavage site. A vector can comprise a donor polynucleotide. The modifications of the target DNA due to NHEJ and/or HR can lead to, for example, mutations, deletions, alterations, integrations, gene correction, gene replacement, gene tagging, transgene insertion, nucleotide deletion, gene disruption, and/or gene mutation. The process of integrating non-native nucleic acid into genomic DNA can be referred to as genome engineering.

The CRISPR system proteins disclosed herein may comprise one or more modifications. The modification may comprise a post-translational modification. The modification of the target nucleic acid may occur at least 1, 2, 3, 4, 5, 6, 7, 8, 9, 10, 20, 30, 40, 50, 60, 70, 80, 90, 100 or more amino acids away from the either the carboxy terminus or amino terminus end of the CRISPR system protein. The modification of the CRISPR system protein may occur at most 1, 2, 3, 4, 5, 6, 7, 8, 9, 10, 20, 30, 40, 50, 60, 70, 80, 90, 100 or more amino acids away from the carboxy terminus or amino terminus end of the CRISPR system protein. The modification may occur due to the modification of a nucleic acid encoding a CRISPR system protein. Exemplary modifications can comprise methylation, demethylation, acetylation, deacetylation, ubiquitination, deubiquitination, deamination, alkylation, depurination, oxidation, pyrimidine dimer formation, transposition, recombination, chain elongation, ligation, glycosylation. Phosphorylation, dephosphorylation, adenylation, deadenylation, SUMOylation, deSUMOylation, ribosylation, deribosylation, myristoylation, remodelling, cleavage, oxidoreduction, hydrolation, and isomerization. The CRISPR system can comprise a modified form of a wild type exemplary CRISPR. The modified form of the wild type exemplary CRISPR system can comprise an amino acid change (e.g., deletion, insertion, or substitution) that reduces the nucleic acid-cleaving activity of the CRISPR system.

Genetic modifications of the disclosure can include substitutions, additions, and deletions, or any combination thereof. In some instances, the CRISPR system can target a nucleic acid. The CRISPR system can target DNA. In some instances, the CRISPR system comprises nickase activity. In some embodiments, the CRISPR system is modified to target a nucleic acid but is enzymatically inactive (e.g., does not have endonuclease or nickase activity). In some embodiments, simply by targeting an enzymatically inactive CRISPR system to a target nucleic acid the expression of one or more alkaloids is impacted. For example, targeting an enzymatically inactive CRISPR system to a target nucleic acid may function to prevent or displace a transcription factor that would otherwise be present thereby influencing the expression of a gene product involved in alkaloid production.

In some embodiments, the CRISPR system can be active at temperatures suitable for growth and culture of a fungus or fungal cells, such as for example and without limitation, about 20 degrees Celsius to about 35 degrees Celsius, preferably about 23 degrees Celsius to about 32 degrees Celsius, and most preferably about 25 degrees Celsius to about 28 degrees Celsius.

Accordingly, methods and compositions of the disclosure can be used at temperatures suitable for growth and culture of a fungus or fungal cells, such as for example and without limitation, 20 degrees Celsius to about 35 degrees Celsius, preferably about 23 degrees Celsius to about 32 degrees Celsius, and most preferably about 25 degrees Celsius to about 28 degrees Celsius.

In some embodiments, the gene editing system is provided on a vector. For example, a non-replicating vector, such as, a viral vector. In other embodiments, the gene editing system is provided in a complex wherein the nucleic acid-targeting nucleic acid is pre-associated with a CRISPR/Cas protein. In some embodiments, the gene editing system is provided as part of an expression cassette on a suitable vector, configured for expression of a CRISPR system in a desired host cell (e.g., a fungal cell or a fungal protoplast). The vector may allow transient expression of a CRISPR/Cas protein. Alternatively, the vector may allow the expression cassette and/or CRISPR system to be stably maintained in the host cell, such as for example and not limitation, by integration into the host cell genome, including stable integration into the genome. In some embodiments, the host cell is an ancestral cell, thereby providing heritable expression of a CRISPR/Cas protein.

Figure 19:
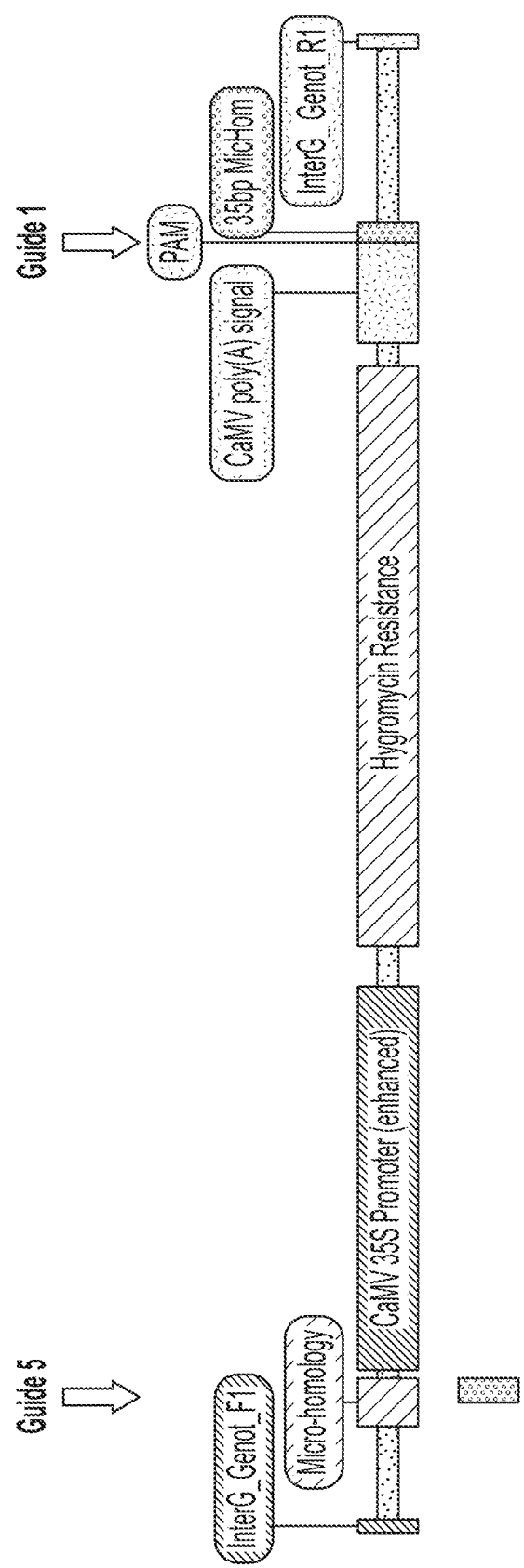
FIG. 19 show a map of a plasmid constructed for a microhomology end joint map for a double stranded break (DSB) in a DNA. The plasmid includes a guided Cas enzyme and a hygromycin resistance gene as a DNA repair template. Arrows show points of DSB microhomology integration.
Figure 20:
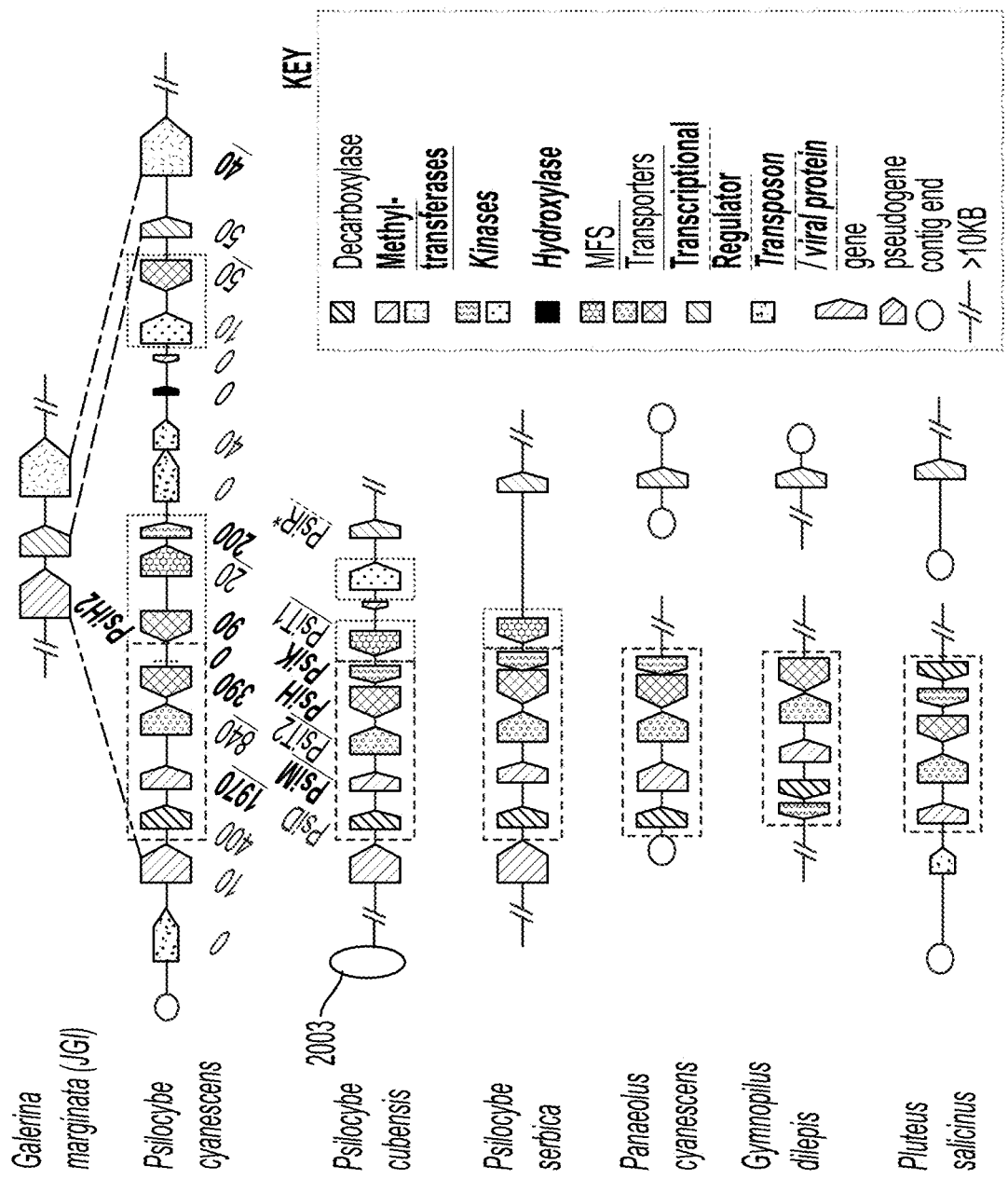
FIG. 20 shows an illustration of genes from the psilocybin cluster from six psilocybin-producing fungal species. The genes are color coded in grayscale according to the annotated key.

Genetic Engineering Using Homologous Directed Repair and Methods for Introducing Fungal DNA In some embodiments, an exogenous nucleic acid can be integrated into the genome of a genetically modified organism described herein by homologous recombination. Homologous recombination permits site specific modifications in endogenous genes and thus inherited or acquired mutations may be corrected, and/or novel alterations may be engineered into the genome of the genetically modified organism. One method that can lead to precise sequence alterations at specified genomic locations is by using a homologous directed repair (HDR) method (FIG. 19).

Designed HDR donor templates can contain sequences homologous to the specific sequence flanking the cut site, referred to herein as "homology arms". In some embodiments, a homology arm is at least: 10-nts, 15-nts, 20-nts, 25-nts, 30-nts, 35-nts, 40-nts, 50-nts, 55-nts, 60-nts, 65-nts, or 70-nts, 80-nts, 90-nts, 100-nts, 110-nts, 120-nts, 130-nts, or 140-nts.

HDR for Self-Replicating Plasmids and Protoplasts

In some embodiments HDR is carried out using self-replicating plasmids and protoplasts. In some embodiments, a PsiD gene locus is targeted. In some embodiments, targeting a PsiD locus produces an edited, non-genetically modified *Psilocybe cubensis* fungus that is genetically engineered. In some embodiments, targeting a PsiD locus in a genetic engineering process results in overexpressing PsiD. In some embodiments, the targeted PsiD gene locus undergoes HDR to produce a gene-edited *Psilocybe cubensis* fungus that overexpress PsiD. In some embodiments, this HDR method results in a non-genetically modified fungus comprising a genetic modification. B-AMA1 replication origin allows a plasmid to replicate in a fungal cell without being integrated into the genome of the fungal cell. In some embodiments, B-AMA1 replication origin-containing plasmid is allowed to replicate in a fungal cell without being integrated into the genome of the fungal cell. In some embodiments, the B-AMA1 replication origin-containing plasmid further comprises a hygromycin resistance gene sequence. In some embodiments, the B-AMA1 replication origin-containing plasmid further comprises a Cas endonuclease. In some embodiments, the Cas endonuclease is an SpCas enzyme. In some embodiments, the Cas endonuclease is an optimized SpCas enzyme sequence. In some embodiments, the optimized SpCas enzyme comprises a sequence with a percent identity of about: 80%, 85%, 90%, 91% 92%, 93%, 94%, 95%, 96%, 97%, 98%, 99%, 100% to any one of SEQ ID NOs: 640-647. In some embodiments, the optimized SpCas enzyme comprises a sequence is any one of SEQ ID NOs: 640-647. In some embodiments, a hygromycin-resistant cassette and transfected protoplasts can then be selected in the presence of hygromycin until only until HDR is completed. Antibiotic selection is then removed and the plasmid is no longer part of the protoplast. This produces a gene-edited fungus. In some embodiments, the resistance cassette can be re-used to target a subsequent locus in the genome as needed. In some embodiments, Golden Gate cloning strategy is used to produce the gene-edited fungus. In some embodiments, the plasmid comprises an SpCas9 enzyme. In some embodiments, the plasmid comprises a codon optimized SpCas9 enzyme. Exemplary Cas endonucleases comprising a SpCas9 enzyme are shown in TABLE 5A. In some embodiments, the Cas endonuclease comprises a sequence selected from the group consisting of SEQ ID NOs: 640-657. Additional exemplary Cas sequences are shown in TABLE 5B. In some embodiments, the Cas endonuclease comprises a sequence selected from the group consisting of SEQ ID NOs: 640-657, and 203. In some embodiments, the Cas enzyme used is a SpCas9 sequence *Utsilago maydis* codon-optimized on the backbone.

TABLE 5A

Exemplary Sequences comprising SpCas9 for HDR methods

| SEQ ID NO | Name | Sequence |
|---|---|---|
| 640 | SpCas9 codon-optimised for *Ustilago maydis*, CDS sequence | atgccgcctaagaagaaacgcaaggttgaggataagaagtacagcatcggactcgacatc ggtactaactcggtaggatgggcagtcatcacggatgaatacaaggttccttccaagaagtt taaggtccttggtaacaccgaccgccattctatcaagaagaacctcattggcgctttgctcttt gactcaggagaaaccgctgaggcgacacgcctcaaacgcacggcacgtcgacgttatac acgcagaaagaatcgtatctgctatctgcaggaaatcttttcgaacgaaatggcaaaagttg atgacagcttcttccatcgcctggaggaatcgtttctcgtgaggaggacaagaagcacga gagacatcctatcttcggcaacattgtcgatgaggtcgcttaccacgagaagtaccctactat ctaccaccttagaaagaagctcgtagactcaactgacaaagcggatcttcgtctgatctattt ggctcttgcccacatgatcaagttccgtggtcattttctcatcgaaggcgaccttaatcccga caactcggacgtcgataagctgtttatccagctcgtacagacatacaaccagctcttcgaag aaaacccaattaatgcttccggtgttgatgcaaaagctatcctcagcgcgagattgagcaag agcagacgcctcgaaaacctcatcgcccaattgcctggtgaaaagaagaacggcttgttcg gcaatcttattgccctgagccttggcctcactccgaacttcaagtcgaacttcgatcttgcgg aagatgccaagctgcaactctccaaggacacgtacgatgatgacttggacaatctccttgcc cagattggcgatcaatacgccgatcttttcctcgccggcgaagaacttgtcggacgcaatctt gctctcagacatccttcgcgtcaacactgagatcaccaaagcccctctctctgcctcgatgat caagcgctatgacgaacaccaccaggatctcacgctccttaaggcattggtgcgtcagcag ttgcctgagaagtacaaagagattttctttgatcagtcgaagaacggatacgctggctacatc gacggtggcgcttctcaggaggagttctacaagtttatcaaacccattcttgagaagatggat ggcacggaggagctcctcgtcaagctgaatcgcgaggacctcctccgtaagcaacgtac gttcgacaatggctcgattccacaccagattcatctgggcgaactccacgccatcctcagga ggcaggaggacttctatcccttcctcaaggataatcgagagaaaattgagaagatcctcac attccgcatcccctattatgtaggccactcgctcgcgggaaactctcgctttgcctggatgac ccgcaagtcggaagaaacaatcacccgtggaacttcgaagaggtggtggacaagggtg catctgcgcagtcgtttattgagaggatgacaaactttgataagaacctcccgaatgagaaa gtcctgccaaaacattccctcctgtatgaatacttcacggtctataacgaactgacaaaggtg aagtacgtgaccgaggtatgcgtaagcctgcctttctttcgggtgagcagaagaaagctat tgtcgacttgttgttcaagaccaaccgcaaggtcactgtcaagcaactgaaggaagattactt caagaaaatcgagtgttttgattcggtagagatctcgggcgtcgaggacaggttcaacgcct ctctcggcacctatcacgatcttctcaagatcatcaaggacaaagactttcttgacaacgaag agaacgaggatattctcgaggacatcgtgctcaccctcactttgttcgaagatcgcgaaatg attgaggaacgtcttaagacatatgctcacttgttcgacgacaaagtgatgaagcagctgaa gcgtaggcgatacacaggttggggccgcctctcgcgcaagctgattaacggtatccgcga caagcaatccggcaagacaatcttggatttccttaagagcgacggttttgctaaccgcaactt catgcagctcatccacgacgacagccttacgttcaaggaggacatccagaaggcccaggt ttccggacaaggtgactctctccatgagcacatcgctaacctggggggaagccccgcgat caagaaaggtatcctccagaccgtcaaagttgtggacgagctggtcaaggtaatgggccg acacaaaccggagaacattgttatcgagatggcacgagagaatcagacgacccagaaag gccaaaagaactccagagaacgtatgaaacgaatcgaagagggtatcaaggaactggga |

TABLE 5A-continued

Exemplary Sequences comprising SpCas9 for HDR methods

| SEQ ID NO | Name | Sequence |
|---|---|---|
| | | tcgcagatcctgaaggagcacccgttgagaacacgcagctccaaaacgaaaagctgtac<br>ctctactacttgcaaaatggtagggatatgtacgtcgaccaggaactggatattaatcgtctgt<br>ccgactacgacgttgaccacatcgtgccccaatcgtttctcaaggatgactcgatcgataat<br>aaagtacttacgcgctcagacaagaaccgaggtaaatcggacaatgtcccatcggaggaa<br>gtcgtgaagaagatgaagaactattggcgcaacttcttaacgcaaagctgatcacccaga<br>ggaaattcgacaacctcaccaaagcagaacgcggcggcctctccgagctcgacaaggct<br>ggatttatcaagcgtcagctcgtcgaaacgcgtcagattaccaagcacgtcgcacagatcc<br>tggatagccgcatgaacacaaagtacgacgaaaacgacaagctcatccgtgaggttaagg<br>tcatcaccttgaagtcgaaactcgtgtcggacttccgcaaagattttcagttctataaagttag<br>agagatcaacaactaccaccatgcgcatgacgcctacctcaatgccgtgtgggcaccgc<br>acttattaagaaatacccgaagctcgagtccgagtttgtctacggcgattacaaggtatacga<br>cgttcgcaagatgattgccaaatcggagcaggagatcggtaaggccactgccaagtacttc<br>ttttactcgaacatcatgaatttcttcaaaacagaaatcaccctcgccaacggcgagattcgc<br>aaacgaccactcatcgagactaacggtgaaacgggagagatcgtctgggataagggccg<br>agactttgctacggttcgaaaggtcctttcgatgcctcaagtgaacatcgtcaagaaaacgg<br>aggtccaaaccggtggcttcagcaaggagtcgattctgccgaaacgcaattcggacaaatt<br>gattgcacgcaagaaggattgggaccctaagaaatatggcggcttcgattcaccgacagtg<br>gcctattcggttctggtcgtcgcgaaagtggagaagggcaagtcaaagaagctcaagtca<br>gtgaaggagctcctgggaatcaccatcatggaacgttcctcttttgagaagaaccctatcga<br>ctttctcgaggctaagggctacaaagaggtcaagaaagatctcatcatcaaactcccaaaat<br>actcacttttcgagctcgagaacggccgtaaacgaatgctggcgagcgcaggagagcttc<br>aaaagggaaatgaactggctttgccctccaagtacgtcaacttcctctacctcgcaagccatt<br>atgagaagttgaagggtagccccgaggacaacgaacaaaagcagctcttcgtggagcaa<br>cacaaacattacctggatgaaatcatcgagcaaatctcggagtttagcaagcgagtgatctt<br>ggctgatgccaacctcgacaaggtgttgtctgcctacaacaagcatcgagataagccgatt<br>cgcgagcaggccgagaacatcatccacctcttcactctcactaacttgggtgcgcctgcgg<br>cgtttaaatactttgacacgaccatcgaccgcaagcgttacacaagcacgaaggaagtcct<br>cgacgctacactgatccatcagtcgatcaccggtctgtacgaaacccgcatcgatctgtctc<br>aactgggcggtgacagcggcggctacccatacgatgtgcccgattacgctagcggcgga<br>aagcgtcccgcagccactaagaaggctggacaggccaagaagaagaagtga |
| 641 | SpCas9 codon-optimised for *Ustilago maydis*, mutated, CDS sequence | atgccgcctaagaagaaacgcaaggttgaggataagaagtacagcatcggactcgacatc<br>ggtactaactcggtaggatgggcagtcatcacggatgaatacaaggttccttccaagaagtt<br>taaggtccttggtaacaccgacgacagacattctatcaagaagaacctcattggcgctttgctctttt<br>gactcaggagaaaccgctgaggcgacacgcctcaaacgcacggcacgtcgacgttatac<br>acgcagaaagaatcgtatctgctatctgcaggaaatctttttcgaacgaaatggcaaaagttg<br>atgacagcttcttccatcgcctggaggaatcgttctcgtggaggaggacaagaagcacga<br>gagacatcctatcttcggcaacattgtcgatgaggtcgcttaccacgagaagtaccctactat<br>ctaccaccttagaaagaagctcgtagactcaactgacaaagcggatcttcgtctgatctattt<br>ggctcttgcccacatgatcaagttccgtggtcatttttctcatcgaaggcgaccttaatcccga<br>caactcggacgtcgataagctgtttatccagctcgtacagacataaaccagctcttcgaag<br>aaaacccaattaatgcttccggtgttgatgcaaaagctatcctcagcgcgagattgagcaag<br>agcagacgcctcgaaaacctcatcgcccaattgcctggtgaaaagaagaacggcttgttcg<br>gcaatcttattgccctgagccttggcctcactccgaacttcaagtcgaacttcgatcttgcgg<br>aagatgccaagctgcaactctccaaggacacgtacgatgatgacttggacaatctccttgcc<br>cagattggcgatcaatacgccgatctttcctgcgggcgaagaacttgtcggacgcaatctt<br>gctctcagacatccttcgcgtcaacactgagatcaccaaagccctctctctgcctcgatgat<br>caagcgctatgacgaacaccaccaggatctcacgctccttaaggcattggtgcgtcagcag<br>ttgcctgagaagtacaaagagattttctttgatcagtcgaagaacggatacgctggctacatc<br>gacggtggcgcttctcaggaggagttctacaagtttatcaaacccattcttgagaagatggat<br>ggcacggaggagctcctcgtcgaagctgaatcgcgaggacctcctccgtaagcaacgtac<br>gttcgacaatggctcgattccacaccagattcatctgggcgaactccacgccatcctcagga<br>ggcaggaggacttctatccccttcctcaaggataatcgagagaaaattgagaagatcctcac<br>attccgcatccccatttatgtaggcccactcgctcgcggaaactctcgctttgcctggatgac<br>ccgcaagtcggaagaaacaatcaccccgtggaacttcgaagaggtggtggacaagggtg<br>catctgcgcagtcgtttattgagaggatgacaaactttgataagaacctcccgaatgagaaa<br>gtcctgccaaaacattccctcctgtatgaatacttcacggtctataacgaactgacaaaggtg<br>aagtacgtgaccgagggtatgcgtaagcctgcctttcttcgggtgagcagaagaaagctat<br>tgtcgacttgttgttcaagaccaaccgcaaggtcactgtcaagcaactgaaggaagattactt<br>caagaaaatcgagtgttttgattcggtagagatctcgggcgtcgaggacaggttcaacgcct<br>ctctcggcacctatcacgatcttctcaagatcatcaaggacaaagacttcttgacaacgaag<br>agaacgaggatattctcgaggacatcgtgctcaccctcactttgttcgaagatcgcgaaatg<br>attgaggaacgtcttaagacatatgctcacttgttcgacgacaaagtgatgaagcagctgaa<br>gcgtaggcgatacacaggttggggccgcctctcgcgcaagctgattaacggtatccgcga<br>caagcaatccggcaagacaatcttggatttccttaagagcgacggttttgctaaccgcaactt<br>catgcagctcatccacgacgacagccttacgttcaaggaggacatccagaaggcccaggt<br>ttccgacaaggtgactctctccatgagcgacatcgctaacctggcgggaaagccccgcgat<br>caagaaaggtatcctccagaccgtcaaagttgtggacgagctggtcaaggtaatgggccg<br>acacaaaccggagaacattgttatcgagatggcacgagagaatcagacgacccagaaag<br>gccaaaagaactccagagaacgtatgaaacgaatcgaagagggtatcaaggaactggga<br>tcgcagatcctgaaggagcacccgttgagaacacgcagctccaaaacgaaaagctgtac<br>ctctactacttgcaaaatggtagggatatgtacgtcgaccaggaactggatattaatcgtctgt<br>ccgactacgacgttgaccacatcgtgccccaatcgtttctcaaggatgactcgatcgataat<br>aaagtacttacgcgctcagacaagaaccgaggtaaatcggacaatgtcccatcggaggaa<br>gtcgtgaagaagatgaagaactattggcgccaacttcttaacgcaaagctgatcacccaga<br>ggaaattcgacaacctcaccaaagcagaacgcggcggcctctccgagctcgacaaggct |

TABLE 5A-continued

Exemplary Sequences comprising SpCas9 for HDR methods

| SEQ ID NO | Name | Sequence |
|---|---|---|
| | | ggatttatcaagcgtcagctcgtcgaaacgcgtcagattaccaagcacgtcgcacagatcc |
| | | tggatagccgcatgaacacaaagtacgacgaaaacgacaagctcatccgtgaggttaagg |
| | | tcatcaccttgaagtcgaaactcgtgtcggacttccgcaaagattttcagttctataaagttag |
| | | agagatcaacaactaccaccatgcgcatgacgcctacctcaatgccgtcgtgggcaccgc |
| | | acttattaagaaatacccgaagctcgagtccgagtttgtctacggcgattacaaggtatacga |
| | | cgttcgcaagatgattgccaaatcggagcaggagatcggtaaggccactgccaagtacttc |
| | | ttttactcgaacatcatgaatttcttcaaaacagaaatcaccctcgccaacggcgagattcgc |
| | | aaacgaccactcatcgagactaacggtgaaacgggagagatcgtctgggataagggccg |
| | | agactttgctacggttcgaaaggtcctttcgatgcctcaagtgaacatcgtcaagaaaacgg |
| | | aggtccaaaccggtggcttcagcaaggagtcgattctgccgaaacgcaattcggacaaatt |
| | | gattgcacgcaagaaggattgggaccctaagaaatatggcggcttcgattcaccgacagtg |
| | | gcctattcggttctggtcgtcgcgaaagtggagaagggcaagtcaaagaagctcaagtca |
| | | gtgaaggagctcctgggaatcaccatcatggaacgttcctcttttgagaagaaccctatcga |
| | | ctttctcgaggctaagggctacaaagaggtcaagaaagatctcatcatcaaactcccaaaat |
| | | actcactttcgagctcgagaacggccgtaaacgaatgctggcgagcgcaggagagcttc |
| | | aaaagggaaatgaactggctttgcctccaagtacgtcaacttcctctacctcgcaagccatt |
| | | atgagaagttgaagggtagcccgaggacaacgaacaaaagcagctcttcgtggagcaa |
| | | cacaaacattacctggatgaaatcatcgagcaaatctcggagtttagcaagcgagtgatctt |
| | | ggctgatgccaacctcgacaaggtgttgtctgcctacaacaagcatcgagataagccgatt |
| | | cgcgagcaggccgagaacatcatccacctcttcactctcactaacttgggtgcgcctgcgg |
| | | cgtttaaatactttgacacgaccatcgaccgcaagcgttacacaagcacgaaggaagtcct |
| | | cgacgctacactgatccatcagtcgatcaccggtctgtacgaaaccgcatcgatctgtctc |
| | | aactgggtggtgactcgggtggctacccatacgatgtgcccgattacgctagcggcggaa |
| | | agcgtcccgcagccactaagaaggctggacaggccaagaagaagaagtga |
| 642 | SpCas9 codon-optimised for *Agaricus bisporus*, CDS sequence | atggataagaagtactctatcggcctcgatatcggtaccaactctgtcggttgggctgtcatc |
| | | accgatgaatacaaggtcccttctaagaagttcaaggtcctggtaacaccgatcgtcattct |
| | | atcaagaagaacctcatcggtgctctcctcttcgattctggtgaaaccgctgaagctacccgt |
| | | ctcaagcgtaccgctcgtcgtcgttacacccgtcgtaagaaccgtatctgctacctccaaga |
| | | aatcttctctaacgaaatggctaaggtcgaaggtctcttcttcctccatcgtctcgaagaatctttcct |
| | | cgtcgaagaagataagaagcatgaacgtcatcctatcttcggtaacatcgtcgatgaagtcg |
| | | cttaccatgaaaagtaccctaccatctaccatctccgtaagaagctcgtcgattctaccgata |
| | | aggctgatctccgtctcatctacctcgctctcgctcatatgatcaagttccgtggtcatttcctc |
| | | atcgaaggtgatctcaaccctgataactctgatgtcgataagctcttcatccaactcgtccaa |
| | | acctacaaccaactcttcgaagaaaaccctatcaacgcttctggtgtcgatgctaaggctatc |
| | | ctctctgctcgtctctctaagtctcgtcgtctcgaaaacctcatcgctcaactccctggtgaaa |
| | | agaagaacggcctcttcggtaacctcatcgctctctctctcggcctcacccctaacttcaagt |
| | | ctaacttcgatctcgctgaagatgctaagctccaactctctaaggatacctacgatgatgatct |
| | | cgataacctcctcgctcaaatcggtgatcaatacgctgatctcttcctcgctgctaagaacct |
| | | ctctgatgctatcctcctctctgatatcctccgtgtcaacaccgaaatcaccaaggctcctctc |
| | | tctgcttctatgatcaagcgttacgatgaacatcatcaagatctcaccctcctcaaggctctcg |
| | | tccgtcaacaactccctgaaaagtacaaggaaatcttcttcgatcaatctaagaacggttacg |
| | | ctggttacatcgatggtggtgcttctcaagaagaattctacaagttcatcaagcctatcctcga |
| | | aaagatggatggtaccgaagaactcctcgtcaagctcaaccgtgaagatctcctccgtaag |
| | | caacgtaccttcgataacggttctatccctcatcaaatccatctcggtgaactccatgctatcc |
| | | tccgtcgtcaaggagatttctaccctttcctcaaggataaccgtgaaaagatcgaaaagatcc |
| | | tcaccttccgtatcccttactacgtcggtcctctcgctcgtggtaactctcgtttcgcttggatg |
| | | acccgtaagtctgaagaaccatcaccccttggaacttcgaagaagtcgtcgataagggtg |
| | | cttctgctcaatctttcatcgaacgtatgaccaacttcgataagaaccctcctaacgaaaaggt |
| | | cctccctaagcattctctcctctacgaatacttcaccgtctacaacgaactcaccaaggtcaa |
| | | gtacgtcaccgaaggtatgcgtaagcctgctttcctctctggtgaacaaaagaaggctatcg |
| | | tcgatctcctcttcaagaccaaccgtaaggtcaccgtcaagcaactcaaggaagattacttc |
| | | aagaagatcgaatgcttcgattctgtcgaaatctctggtgtcgaagatcgtttcaacgcttctc |
| | | tcggtacctaccatgatctcctcaagatcatcaaggataaggatttcctcgataacgaagaaa |
| | | acgaagatatcctcgaagatatcgtcctcaccctcttcgaagatcgtgaaatgatcg |
| | | aagaacgtctcaagacctacgctcatctcttcgatgataaggtcatgaagcaactcaagcgt |
| | | cgtcgttacaccggtgggtcgtctctctcgtaagctcatcaacggtatccgtgataagcaa |
| | | tctggtaagaccatcctcgatttcctcaagtctgatggtttcgctaaccgtaacttcatgcaact |
| | | catccatgatgattctctcaccttcaaggaagatatccaaaaggctcaagtctctgtcaagg |
| | | tgattctctccatgaacatatcgctaacctcgctggttctcctgctatcaagaagggtatcctc |
| | | caaaccgtcaaggtcgtcgatgaactcgtcaaggtcatgggtcgtcataagcctgaaaaca |
| | | tcgtcatcgaaatggctcgtgaaaaccaaaccacccaaaagggtcaaaagaactctcgtga |
| | | acgtatgaagcgtatcgaagaggtatcaaggttctcaaatcctcaaggaacat |
| | | cctgtcgaaaacacccaactccaaaacgaaaagctctacctctactacctccaaaacggtc |
| | | gtgatatgtacgtcgatcaagaactcgatatcaaccgtctctctgattacgatgtcgatcatat |
| | | cgtccctcaatctttcctcaaggatgattctatcgataacaaggtcctcacccgttctgataag |
| | | aaccgtggtaagtctgataacgtcccttctgaagaagtcgtcaagaagatgaagaactactg |
| | | gcgtcaactcctcaacgctaagctcatcacccaacgtaagttcgataacctcaccaaggctg |
| | | aacgtggtggtctctctgaactcgataagctggtttcatcaagcgtcaactcgtcgaaacc |
| | | cgtcaaatcaccaagcatgtcgctcaaatcctcgattctcgtatgaacaccaagtacgatga |
| | | aaacgataagctcatccgtgaagtcaaggtcatcactctaagctctaagctgtctcctgattt |
| | | ccgtaaggatttccaattctacaaggtccgtgaaatcaacaactaccatcatgctcatgatgc |
| | | ttacctcaacgctgtcgtcggtaccgctctcatcaagaagtacccta agctcgaatctgaatt |
| | | cgtctacggtgattacaaggtctacgatgtccgtaagatgatcgctaagtctgaacaagaaa |
| | | tcggtaaggctaccgctaagtacttcttctactctaacatcatgaacttcttcaagaccgaaat |
| | | caccctcgctaacggtgaaatccgtaagcgtcctctcatcgaaaccaacggtgaaaccggt |

TABLE 5A-continued

Exemplary Sequences comprising SpCas9 for HDR methods

| SEQ ID NO | Name | Sequence |
|---|---|---|
| | | gaaatcgtctgggataagggtcgtgatttcgctaccgtccgtaaggtcctctctatgcctcaa<br>gtcaacatcgtcaagaagaccgaagtccaaaccggtggtttctctaaggaatctatcctccc<br>taagcgtaactctgataagctcatcgctcgtaagaaggattgggatcctaagaagtacggtg<br>gtttcgattctcctaccgtcgcttactctgtcctcgtcgtcgctaaggtcgaaaagggtaagtc<br>taagaagctcaagtctgtcaaggaactcctcggtatcaccatcatggaacgttcttcttcgaa<br>aagaaccctatcgatttcctcgaagctaagggttacaaggaagtcaagaaggatctcatcat<br>caagctccctaagtactctctcttcgaactcgaaaacggtcgtaagcgtatgctcgcttctgct<br>ggtgaactccaaaagggtaacgaactcgctctcccttctaagtacgtcaacttcctctacctc<br>gcttctcattacgaaaagctcaagggttctcctgaagataacgaacaaaagcaactcttcgtc<br>gaacaacataagcattacctcgatgaaatcatcgaacaaatctctgaattctctaagcgtgtc<br>atcctcgctgatgctaacctcgataaggtcctctctgcttacaacaagcatcgtgataagcct<br>atccgtgaacaagctgaaaacatcatccatctcttcaccctcaccaacctcggtgctcctgct<br>gctttcaagtacttcgataccaccatcgatgtaagcgttacacctctaccaaggaagtcctc<br>gatgctaccctcatccatcaatctatcaccggcctctacgaaacccgtatcgatctctctcaa<br>ctcggtggtgatggtatccatggtgtccctgctgctcctaagaagaagcgtaagcctaagaa<br>gaagcgtaagcctaagaagaagcgtaagtaa |
| 643 | SpCas9 codon-<br>optimised for<br>*Agaricus<br>bisporus*,<br>mutated, CDS<br>sequence | atggataagaagtactctatcggcctcgatatcggtaccaactctgtcggttgggctgtcatc<br>accgatgaatacaaggtcccttctaagaagttcaaggtcctcggtaacaccgatcgtcattct<br>atcaagaagaacctcatcggtgctctcctcttcgattctggtgaaaccgctgaagctacccgt<br>ctcaagcgtaccgctcgtcgtcgttacacccgtcggaagaaccgtatctgctacctccaaga<br>aatattctcgaacgaaatggctaaagtcgatgattcttcttccatcgctctcgaagaatcttcc<br>tcgtcgaagaagataagaagcatgaacgtcatcctatcttcggtaacatcgtcgatgaagtcg<br>cttaccatgaaaagtaccctaccatctaccatctccgtaagaagctcgtcgattctaccgata<br>aggctgatctccgtctcatctacctcgctctcgctcatatgatcaagttccgtggtcatttcctc<br>atcgaaggtgatctcaaccctgataactctgatgtcgataagctcttcatccaactcgtccaa<br>acctacaaccaactcttcgaagaaaaccctatcaacgcttctggtgtcgatgctaaggctatc<br>ctctctgctcgtctctctaagtctcgtcgtctcgaaaacctcatcgctcaactccctggtgaaa<br>agaagaacggcctcttcggtaacctcatcgctctctctctcggcctcaccctaacttcaagt<br>ctaacttcgatctcgctgaagatgctaagctccaactctctaaggatacctacgatgatgatct<br>cgataacctcctcgctcaaatcggtgatcaatacgctgatctcttcctcgctgctaagaacct<br>ctctgatgctatcctcctctctgatatcctccgtgtcaacaccgaaatcaccaaggctcctctc<br>tctgcttctatgatcaagcgttacgatgaacatcatcaagatctcaccctcctcaaggctctcg<br>tccgtcaacaactccctgaaaagtacaaggaaatcttcttcgatcaatctaagaacggttacg<br>ctggttacatcgatggtggtgcttctcaagaagaattctacaagttcatcaagcctatcctcga<br>aaagatggatggtaccgaagaactcctcgtcaagctcaaccgtgaagatctcctccgtaag<br>caacgtaccttcgataacggttctatccctcatcaaatccatctcggtgaactccatgctatcc<br>tccgtcgtcaaggaagatttctaccctttcctcaaggataacccgtgaaaagatcgaaaagatcc<br>tcaccttccgtatccctttactacgtcggtcctctcgctcgtggtaactctcgtttcgcttggatg<br>acccgtaagtctgaagaaaccatcaccccttggaacttcgaagaagtcgtcgataagggtg<br>cttctgctcaatctttcatcgaacgtatgaccaacttcgataagaacctccctaacgaaaaggt<br>cctccctaagcattctcctctacgaatacttcaccgtctacaacgaactcaccaaggtcaa<br>gtacgtcaccgaaggtatgcgtaagcctgctttcctctctggtgaacaaaagaaggctatcg<br>tcgatctcctcttcaagaccaaccgtaaggtcaccgtcaagcaactcaaggaagattacttc<br>aagaagatcgaatgcttcgattctgtcgaaatctctggtgtcgaagatcgtttcaacgcttctc<br>tcggtacctaccatgatctcctcaagatcatcaaggataaggatttcctcgataacgaagaa<br>acgaagatatcctcgaagatatcgtcctcaccctcaccctcttcgaagatcgtgaaatgatcg<br>aagaacgtctcaagacctacgctcatctcttcgatgataaggtcatgaagcaactcaagcgt<br>cgtcgttacaccggtttgggtcgtctctctcgtaagctcatcaacggtatccgtgataagcaa<br>tctggcaagaccatcctggactttctgaagtctgatggtttcgcgaaccgtaacttcatgcaa<br>ctcatccacgacgattcgtaacgttcaaagaagatatccaaaaggctcaagtctctggtca<br>aggtgattctctccatgaacatatcgctaacctcgctggttctcctgctatcaagaagggtatc<br>ctccaaaccgtcaaggtcgtcgatgaactcgtcaaggtcatgggtcgtcataagcctgaaa<br>acatcgtcatcgaaatggctcgtgaaaaccaaaccacccaaaagggtcaaaagaactctc<br>gtgaacgtatgaagcgtatcgaagaaggtatcaaggaactcggttctcaaatcctcaagga<br>acatcctgtcgaaaacacccaactccaaaacgaaaagctctacctctactacctccaaaac<br>ggtcgtgatatgtacgtcgatcaagaactcgatatcaaccgtctatcggattacgatgtcgat<br>catatcgtgccacaatcgttcctcaaagatgattctatcgataacaaggtcctcacccgttctg<br>ataagaaccgtggtaagtctgataacgtcccttctgaagaagtcgtcaagaagatgaagaa<br>ctactggcgtcaactcctcaacgctaagctcatcacccaacgtaagttcgataacctcacca<br>aggctgaacgtggtggcctctctgaactcgataaggctggtttcatcaagcgtcaactcgtc<br>gaaacccgtcaaatcaccaagcatgtcgctcaaatcctcgattctcgtatgaacaccaagta<br>cgatgaaaacgataagctcatccgtgaagtcaaggtcatcacctctcaagtctaagctcgtct<br>ctgatttccgtaaggattccaattctacaaggtccgtgaaatcaacaactaccatcatgctca<br>cgacgcttacctcaacgctgtcgtcggtacggcactgatcaaaagtacctaagctcgaat<br>ctgaattcgtctacggtgattacaaggtctacgatgtccgtaagatgatcgctaagtctgaac<br>aagaaatcggcaaggctacggctaagtacttcttctactcgaacatcatgaacttcttcaaa<br>ccgaaatcaccctcgctaacggtgaaatccgtaagcgtcctctcatcgaaaccaacggtga<br>aaccggtgaaatcgtctgggataagggtcgtgatttcgctaccgtccgtaaggtcctctctat<br>gcctcaagtcaacatcgtcaagaagaccgaagtccaaaccggtggtttctctaaggaatcta<br>tcctccctaagcgtaactctgataagctcatcgctcgtaagaaggattgggatcctaagaagt<br>acggtggtttcgattctcctaccgtcgcttactctgtcctcgtcgtcgctaaggtcgaaaagg<br>gtaagtctaagaagctcaagtctgtcaaggaactcctcggtatcaccatcatggaacgttctt<br>ctttcgaaaagaaccctatcgatttcctcgaagctaagggttacaaggaagtcaagaaggat<br>ctcatcatcaagctccctaagtactctctcttcgaactcgaaaacggtcgtaagcgtatgctc<br>gcttctgctggtgaactccaaaagggtaacgaactcgctctcccttctaaatacgtcaacttc |

TABLE 5A-continued

Exemplary Sequences comprising SpCas9 for HDR methods

| SEQ ID NO | Name | Sequence |
|---|---|---|
| | | ctgtacctggcttcgcattacgaaaagctcaagggttcgccagaggataacgaacaaaagc<br>aactcttcgtcgaacaacataagcattacctcgatgaaatcatcgaacaaatctctgaattctc<br>taagcgtgtcatcctcgctgatgctaacctcgataaggtcctctctgcttacaacaagcatcgt<br>gataagcctatccgtgaacaagctgaaaacatcatccatctcttcaccctcaccaacctcggt<br>gctcctgctgctttcaagtacttcgataccaccatcgatcgtaagcgttacacctctaccaag<br>gaagtcctcgatgctaccctcatccatcaatctatcaccggcctctacgaaacccgtatcgat<br>ctctctcaactcggtggtgatggtatccatggtgtccctgctgctcctaagaagaagcgtaag<br>cctaagaagaagcgtaagcctaagaagaagcgtaagtaaagtagatgccgaccggatctg<br>tcgatcgacaagctcgagcggccgcagtagatgccgaccgggatccacttaacgttactg<br>aaatcatcaaacagcttgacgaatctggatataagatcgttggtgtcgatgtcagctccgga<br>gttgagacaaatggtgttcaggatctcgataagatacgttcatttgtccaagcagcaaagagt<br>gccttctagtgatttaatagctccatgtcaacaagaataaaacgcgtttcgggtttacctcttcc<br>agatacagctcatctgcaatgcattaatgcattggacctcgcaaccctagtacgcccttcag<br>gctccggcgaagcagaagaatagcttagcagagtctattttcattttcgggagacgagatca<br>agcagatcaacggtcgtcaagagacctacgagactgaggaatccgctcttggctccacgc<br>gactatatttgtctctaattgtactttgacatgctcctcttctttactctgatagcttgact<br>atgaaaattccgtcaccagccctgggttcgcaaagataattgcactgtttcttccttgaactc<br>tcaagcctacaggacacacattcatcgtaggtataaacctcgaaaatcattcctactaagatgg<br>gtatacaatagtaaccatgcatggttgcctagtgaatgctccgtaacacccaatacgcggccga<br>aacttttttacaactctcctatgagtcgtttacccagaatgcacaggtacacttgtttagaggta<br>atccttctttctagaagtcctcgtgtactgtgtaagcgcccactccacatctccactcgagcta<br>gctag |
| 644 | pTEF:SpCas9 codon-optimised for *Ustilago maydis*, in the plasmid | gatccatgccgcctaagaagaaacgcaaggttgaggataagaagtacagcatcggactcg<br>acatcggtactaactcggtaggatgggcagtcatcacggatgaatacaaggttccttccaag<br>aagtttaaggtccttggtaacaccgaccgccattctatcaagaagaacctcattggcgctttg<br>ctctttgactcaggagaaaccgctgaggcgacacgcctcaaacgcacggcacgtcgacgt<br>tatacacgcagaaagaatcgtatctgctatctgcaggaaatcttttcgaacgaaatggcaaa<br>agttgatgacagcttcttccatcgcctggaggaatcgtttctcgtggaggaggacaagaagc<br>acgagagacatcctatcttcggcaacattgtcgatgaggtcgcttaccacgagaagtaccct<br>actatctaccaccttagaaagaagctcgtagactcaactgacaaagcggatcttcgtctgatc<br>tatttggctcttgcccacatgatcaagttccgtggtcattttctcatcgaaggcgaccttaatcc<br>cgacaactcggacgtcgataagctgtttatccagctcgtacagacatacaaccagctcttcg<br>aagaaaacccaattaatgcttccggtgttgatgcaaaagctatcctcagcgcgagattgagc<br>aagagcagacgcctcgaaaacctcatcgcccaattgcctggtgaaaagaagaacgcttg<br>ttcggcaatcttattgccctgagcctggcctcactccgaacttcaagtcgaacttcgatcttg<br>cggaagatgccaagctgcaactctccaaggacacgtacgatgatgacttggacaatctcct<br>tgcccagattggcgatcaatacgccgatcttttcctcgcggcgaagaacttgtcggacgcaa<br>tcttgctctcagacatccttcgcgtcaacactgagatcaccaaagcccctctctctgcctcgat<br>gatcaagcgctatgacgaacaccaccaggatctcacgctccttaaggcattggtgcgtcag<br>cagttgcctgagaagtacaaagagattttctttgatcagtcgaagaacggatacgctggcta<br>catcgacggtggcgcttctcaggaggagttctacaagtttatcaaaccattcttgagaagat<br>ggatggcacggaggagctcctcgtcaagctgaatcgcgaggacctcctccgtaagcaac<br>gtacgttcgacaatggctcgattccacaccagattcatctgggcgaactccacgccatcctc<br>aggaggcaggaggacttctatcccttcctcaaggataatcgagagaaaattgagaagatcc<br>tcacattccgcatcccctattatgtaggcccactcgctcgcggaaactctcgctttgcctggat<br>gacccgcaagtcggaagaaacaatcaccccgtggaacttcgaagaggtggtggacaagg<br>gtgcatctgcgcagtcgtttattgagaggatgacaaactttgataagaacctcccgaatgag<br>aaagtcctgccaaaacattccctcctgtatgaatacttcacggtctataacgaactgacaaag<br>gtgaagtacgtgaccgagggtatgcgtaagcctgcctttctttcgggtgagcagaagaaag<br>ctattgtcgacttgttgttcaagaccaaccgcaaggtcactgtcaagcaactgaaggaagatt<br>acttcaagaaaatcgagtgttttgattcggtagagatctcgggcgtcgaggacaggttcaac<br>gcctctctcggcacctatcacgatcttctcaagatcatcaaggacaaagactttcttgacaac<br>gaagagaacgaggatattctcgaggacatcgtgctcaccctcactttgttcgaagatcgcga<br>aatgattgaggaacgtcttaagacatatgctcacttgttcgacgacaaagtgatgaagcagc<br>tgaagcgtaggcgatacacaggttggggccgcctctcgcgcaagctgattaacggtatcc<br>gcgacaagcaatccggcaagacaatcttggatttccttaagagcgacggttttgctaaccgc<br>aacttcatgcagctcatccacgacgacagcctacgttcaaggaggacatccagaaggcc<br>caggtttccggacaaggtgactctctccatgaagcacatcgctaacctggcgggaagcccc<br>gcgatcaagaaaggtatcctccagaccgtcaaagttgtggacgagctggtcaaggtaatg<br>ggccgacacaaaccggagaacattgttatcgagatggcacgagagaatcagacgaccca<br>gaaaggccaaaagaactccagagaacgtatgaaacgaatcgaagagggtatcaaggaac<br>tgggatcgcagatcctgaaggagcaccccgttgagacacgcagctccaaaacgaaaag<br>ctgtacctctactacttgcaaaatggtagggatatgtacgtcgaccaggaactggatattaat<br>cgtctgtccgactacgacgttgaccacatcgtgccccaatcgtttctcaaggatgactcgatc<br>gataataaagtacttacgcgctcagacaagaaccgaggtaaatcggacaatgtcccatcgg<br>aggaagtcgtgaagaagatgaagaactattggccgccaacttcttaacgcaaagctgatcac<br>ccagaggaaattcgacaacctcaccaaagcagaacgcggcggcctctccgagctcgaca<br>aggctggatttatcaagcgtcagctcgtcgaaacgcgtcagattaccaagcacgtcgcaca<br>gatcctggatagccgcatgaacacaaagtacgacgaaaacgacaagctcatccgtgaggt<br>taaggtcatcaccttgaagtcgaaactcgtgtcggacttccgcaaagattttcagttcgtataaa<br>gttagagagatcaacaactaccaccatgcgcatgacgctcacctcaatgccgtcgtgggca<br>ccgcacttattaagaaataccccgaagctcgagtccgagtttgtctacgcgattacaaggtat<br>acgacgttcgcaagatgattgccaaatcggagcaggagatcggtaaggccactgccaagt<br>acttcttttactcgaacatcatgaatttcttcaaaacagaaatcaccctcgccaacggcgagat<br>tcgcaaacgaccactcatcgagactaacggtgaaacgggagagatcgtctgggataagg |

TABLE 5A-continued

Exemplary Sequences comprising SpCas9 for HDR methods

| SEQ ID NO | Name | Sequence |
|---|---|---|
| | | gccgagactttgctacggttcgaaaggtcctttcgatgcctcaagtgaacatcgtcaagaaa |
| | | acggaggtccaaaccggtggcttcagcaaggagtcgattctgccgaaacgcaattcggac |
| | | aaattgattgcacgcaagaaggattgggaccctaagaaatatggcggcttcgattcacga |
| | | cagtggcctattcggttctggtcgtcgcgaaagtggagaagggcaagtcaaagaagctca |
| | | agtcagtgaaggagctcctgggaatcaccatcatggaacgttcctcttttgagaagaaccct |
| | | atcgactttctcgaggctaagggctacaaagaggtcaagaaagatctcatcatcaaactccc |
| | | aaaatactcacttttcgagctcgagaacggccgtaaacgaatgctggcgagcgcaggaga |
| | | gcttcaaaagggaaatgaactggctttgccctccaagtacgtcaacttcctctacctcgcaa |
| | | gccattatgagaagttgaagggtagccccgaggacaacgaacaaaagcagctcttcgtgg |
| | | agcaacacaaacattacctggatgaaatcatcgagcaaatctcggagtttagcaagcgagt |
| | | gatcttggctgatgccaacctcgacaaggtgttgtctgcctacaacaagcatcgagataagc |
| | | cgattcgcgagcaggccgagaacatcatccacctcttcactctcactaacttgggtgcgcct |
| | | gcggcgtttaaatactttgacacgaccatcgaccgcaagcgttacacaagcacgaaggaa |
| | | gtcctcgacgctacactgatccatcagtcgatcaccggtctgtacgaaacccgcatcgatct |
| | | gtctcaactgggcggtgacagcggcggctacccatacgatgtgcccgattacgctagcgg |
| | | cggaaagcgtcccgcagccactaagaaggctggacaggccaagaagaagaagtgagc |
| | | ggccgccggctgcagatcgttcaaacatttggcaataaagttttcttaagattgaatcctgttg |
| | | ccggtcttgcgatgattatcatataaatttctgttgaattacgttaagcatgtaataattaacatgta |
| | | atgcatgacgttatttatgagatgggtttttatgattagagtcccgcaattatacatttaatacgc |
| | | gatagaaaacaaaatatagcgcgcaaactaggataaattatcgcgcgcggtgtcatctatgt |
| | | tactagatccgatgataagctgtcaaacatgagaattcactggccgtcgttttacaacgtcgt |
| | | gactgggaaaaccctggcgttacccaacttaatcgccttgcagcacatccccctttcgccag |
| | | ctggcgtaatagcgaagaggcccgcaccgatcgcccttcccaacagttgcgcagcctgaa |
| | | tggcgaatggcgcctgatgcggtattttctccttacgcatctgtgcggtatttcacaccgcata |
| | | tggtgcactctcagtacaatctgctctgatgccgcatagttaagccagccccgacacccgcc |
| | | aacacccgctgacgcgccctgacgggcttgtctgctcccggcatccgcttacagacaagct |
| | | gtgaccgtctccgggagctgcatgtgtcagaggttttcaccgtcatcaccgaaacgcgcga |
| | | gacgaaagggcctcgtgatacgcctatttttataggttaatgtcatgataataatggtttcttag |
| | | gcggccgcacgctaagtggagttgtccgagtccccgaatcacaagaattaggctcgtgctc |
| | | tgtgagatctctcgcgaaaccagatgaaggaaaaaaatcggaagatcgcgcgaagaagt |
| | | ggggttcgcatggtctaacattgtcgcattcctcacagtttcggctggaaacggcagggaca |
| | | atcacgagaaatgcgcgacgagtattcagttgtccaaaattatgtcagcttgaaagttggaa |
| | | acggcggaagaaaattcgtcaggagggcgttgcggctagggtgaagaacggagacaatt |
| | | tcggctttgaaattggctcgactctgattggatcatgacgcactgctggtccacaaccgtgtc |
| | | gaaggtgccgtctcttactacaggtccgctggaagcaaaatggaaaaagccgctggagccc |
| | | gactacagagccgccgtgttttggtaatcagtcggcaaataggtcagcacagcgcagcgt |
| | | gacaggttcttgcaatttacagcacagctcgtccgtctacgactttgcacaccacaaagtgtg |
| | | cggggagcaaaggagccgatcttggtcgcgcgcaaagccaaggagtcttgaacctgaga |
| | | gtgtgcgtgtcttgtgacgcttgcccttctgtactttgctgtgacactaccaccacatctgtctt |
| | | ggcttttttgttcatacatccacaccgaccatgtcgctattcaacgtcagcaacggtcttcgtac |
| | | cgctctccgaccttctgttgccagctcttcgcgcgttgctgccttttccacaaccgccgctgc |
| | | ccgtctcgccacacccacctctgacaacgttggcagttcgggcaagcctcagcacttgaag |
| | | cagttcaagatctaccgatggaaccctgacaagcccccggagaagcctcgtctgcagtcgt |
| | | acacactggacctcaaccagaccggtccaatggttctcgacgcgctcatcaaaatcaagaa |
| | | cgaaattgaccctacgctcaccttccgtcgctcgtgccgtgagggtatctgcggttcgtgcg |
| | | ctatgaatattgacggtgtcaacacctcgcctgcctctgccggatcgacaagcagaatga |
| | | caccaagatctacccccttgccgcacatgtacattgtcaaggacctcgtgccagacttgaccc |
| | | agttctacaagcagtaccgatccatcgagcctttcctcaagtccaacaacaccccttctgag |
| | | ggtgaacatcttcagtcgcccgaggagcgtcgtcgactcgacggtctgtacgagtgcattct |
| | | gtgcgcgtgctgctccacatcctgcccctcttactggtggaatcaggacgagtaccttggcc |
| | | ccgccgtgctcatgcaggcgtaccgatggatggccgactcgcgtgacgactttggtgagg |
| | | agcgaagacagaagctcgagaacaccttttcgctctaccgatgccttaccatcatgaactgc |
| | | tccaggacctgccccaagaacctcaaccctggtaaggcaattgcacagatcaagaaggac |
| | | atggccgtcggcgcacccaaggcttccgagcgcccatcatggcttcgtcgtaatcttgata |
| | | tatcatatcgttcttcctcagcacttcttttgtcaatttcaaaagtatctaattgcattcaac |
| | | tccgcttgtggtttgttgttcagtgagagtggaaacgctacggggcaagatgagggcagtgttct |
| | | ggcgacggaaaagtgtgcaagtgtctggcctgcgtcctcgctggttccagcagccgatgcag |
| | | gacgtgtacctagcgatttcttcgacagccattgtggcagccgcgattcgccacaatcgta |
| | | cgtgcggccgcaggtggcacttttcggggaaatgtgcgcggaaccccctatttgttttatttttt |
| | | ctaaatacattcaaatatgtatccgctcatgagacaataaccctgataaatgcttcaataatatt |
| | | accgatcctcgatctttgtgcaagctagcccgcctcggcagcaacaaagcagccgagcaa |
| | | gaagcagtacttgccttctgaatcgtgaatgggtacgttcttcaccgctgtgatcagcgaat |
| | | catgaatcaaatcatgagggcattgctgatcatgaatcaaatcatgagggcatttaaaaattc |
| | | agtctgagtcgtgagtagcaagtcggttctggatcggatggcattcatgaatcacagggtcg |
| | | tgaatcatgaatgttcaagtcccctttttctcgagaggctggtgggatcggtgcgaatcacga |
| | | atcatgattgtaattcattgagtgaaggagtttcgcagccacccacagtactagaatcacgaa |
| | | tgacaatattgaaaaaggaagagtatgagtattcaacatttccgtgtcgcccttattccctttt |
| | | ttgcggcatttgccttcctgtttttgctcacccagaaacgctggtgaaagtaaaagatgctgaa |
| | | gatcagttgggtgcacgagtgggttacatcgaactggatctcaacagcggtaagatccttga |
| | | gagttttcgccccgaagaacgttttccaatgatgagcactttaaagttctgctatgtggcgcg |
| | | gtattatcccgtattgacgccgggcaagagcaactcggtcgccgcatacactattctcagaa |
| | | tgacttggttgagtactcaccagtcacagaaaagcatcttacggatggcatgacagtaagag |
| | | aattatgcagtgctgccataaccatgagtgataacactgcggccaacttacttctgacaacg |
| | | atcggaggaccgaaggagctaaccgcttttttgcacaacatgggggatcatgtaactcgcc |
| | | ttgatcgttgggaaccggagctgaatgaagccataccaaacgacgagcgtgacaccacga |
| | | tgcctgtagcaatggcaacaacgttgcgcaaactattaactggcgaactacttactctagctt |

TABLE 5A-continued

Exemplary Sequences comprising SpCas9 for HDR methods

| SEQ ID NO | Name | Sequence |
|---|---|---|
| | | cccggcaacaattaatagactggatggaggcggataaagttgcaggaccacttctgcgctc<br>ggcccttccggctggctggtttattgctgataaatctggagccggtgagcgtgggtctcgcg<br>gtatcattgcagcactggggccagatggtaagccctcccgtatcgtagttatctacacgacg<br>gggagtcaggcaactatggatgaacgaaatagacagatcgctgagataggtgcctcactg<br>attaagcattggtaactgtcagaccaagttactcatatatactttagattgatttaaaacttc<br>attttttaattaaaaggatctaggtgaagatcctttttgataatctcatgaccaaaatcccttta<br>acgtgagttttcgttccactgagcgtcagaccccgtagaaaagatcaaaggatcttcttgaga<br>tccttttttctgcgcgtaatctgctgcttgcaaacaaaaaaaccaccgctaccagcggtggtt<br>tgtttgccggatcaagagctaccaactctttttccgaaggtaactggcttcagcagagcgcaga<br>taccaaatactgtccttctagtgtagccgtagttaggccaccacttcaagaactctgtagcacc<br>gcctacatacctcgctctgctaatcctgttaccagtggctgctgccagtggcgataagtcgtgt<br>cttaccgggttggactcaagacgatagttaccggataaggcgcagcggtcgggctgaacgg<br>ggggttcgtgcacacagcccagcttggagcgaacgacctacaccgaactgagatacctac<br>agcgtgagctatgagaaagcgccacgcttcccgaagggagaaaggcggacaggtatcc<br>ggtaagcggcagggtcggaacaggagagcgcacgagggagcttccaggggaaacgc<br>ctggtatctttatagtcctgtcgggtttcgccacctctgacttgagcgtcgatttttgtgatgc<br>tcgtcagggggcggagcctatgaaaaacgccagcaacgcggcctttttacggttcctggc<br>cttttgctggccttttgctcacatgttctttcctgcgttatcccctgattctgtggataaccgt<br>attaccgcctttgagtgagctgataccgctcgccgcagccgaacgaccgagcgcagcgagtca<br>gtgagcgaggaagcggaagagcgcccaatacgcaaaccgcctctccccgcgcgttggc<br>cgattcattaatgcagctggcacgacaggtttcccgactggaaagcgggcagtgagcgca<br>acgcaattaatgtgagttagctcactcattaggcaccccaggctttacactttatgcttccggc<br>tcgtatgttgtgtggaattgtgagcggataacaatttcacacaggaaacagctatgaccatga<br>ttacgccaagcttTGAGACTTTTCAACAAAGGGTAATATCGGG<br>AAACCTCCTCGGATTCCATTGCCCAGCTATCTGTCACTT<br>CATCAAAAGGACAGTAGAAAAGGAAGGTGGCACCTAC<br>AAATGCCATCATTGCGATAAAGGAAAGGCTATCGTTCA<br>AGATGCCTCTGCCGACAGTGGTCCCAAAGATGGACCCC<br>CACCCACGAGGAGCATCGTGGAAAAAGAAGACGTTCC<br>AACCACGTCTTCAAAGCAAGTGGATTGATGTGATAACA<br>TGGTGGAGCACGACACTCTCGTCTACTCCAAGAATATC<br>AAAGATACAGTCTCAGAAGACCAAAGGGCTATTGAGA<br>CTTTTCAACAAAGGGTAATATCGGGAAACCTCCTCGGA<br>TTCCATTGCCCAGCTATCTGTCACTTCATCAAAAGGAC<br>AGTAGAAAAGGAAGGTGGCACCTACAAATGCCATCAT<br>TGCGATAAAGGAAAGGCTATCGTTCAAGATGCCTCTGC<br>CGACAGTGGTCCCAAAGATGGACCCCCACCCACGAGG<br>AGCATCGTGGAAAAAGAAGACGTTCCAACCACGTCTT<br>CAAAGCAAGTGGATTGATGTGATATCTCCACTGACGTA<br>AGGGATGACGCACAATCCCACTATCCTTCGCAAGACCT<br>TCCTCTATATAAGGAAGTTCATTTCATTTGGAGAGGAC<br>ACGCTGAAATCACCAGTCTCTCTCTACAAATCTATCTC<br>TCTCGAGCTTTCGCAGATCCCGGGGGGCAATGAGATAT<br>GAAAAAGCCTGAACTCACCGCGACGTCTGTCGAGAAG<br>TTTCTGATCGAAAAGTTCGACAGCGTCTCCGACCTGAT<br>GCAGCTCTCGGAGGGCGAAGAATCTCGTGCTTTCAGCT<br>TCGATGTAGGAGGGCGTGGATATGTCCTGCGGGTAAAT<br>AGCTGCGCCGATGGTTTCTACAAAGATCGTTATGTTTA<br>TCGGCACTTTGCATCGGCCGCGCTCCCGATTCCGGAAG<br>TGCTTGACATTGGGGAGTTTAGCGAGAGCCTGACCTAT<br>TGCATCTCCCGCCGTGCACAGGGTGTCACGTTGCAAGA<br>CCTGCCTGAAACCGAACTGCCCGCTGTTCTACAACCGG<br>TCGCGGAGGCTATGGATGCGATCGCTGCGGCCGATCTT<br>AGCCAGACGAGCGGGTTCGGCCCATTCGGACCGCAAG<br>GAATCGGTCAATACACTACATGGCGTGATTTCATATGC<br>GCGATTGCTGATCCCCATGTGTATCACTGGCAAACTGT<br>GATGGACGACACCGTCAGTGCGTCCGTCGCGCAGGCTC<br>TCGATGAGCTGATGCTTTGGGCCGAGGACTGCCCCGAA<br>GTCCGGCACCTCGTGCACGCGGATTTCGGCTCCAACAA<br>TGTCCTGACGGACAATGGCCGCATAACAGCGGTCATTG<br>ACTGGAGCGAGGCGATGTTCGGGGATTCCCAATACGA<br>GGTCGCCAACATCTTCTTCTGGAGGCCGTGGTTGGCTT<br>GTATGGAGCAGCAGACGCGCTACTTCGAGCGGAGGCA<br>TCCGGAGCTTGCAGGATCGCCACGACTCCGGGCGTATA<br>TGCTCCGCATTGGTCTTGACCAACTCTATCAGAGCTTG<br>GTTGACGGCAATTTCGATGATGCAGCTTGGGCGCAGGG<br>TCGATGCGACGCAATCGTCCGATCCGGAGCCGGGACT<br>GTCGGGCGTACACAAATCGCCCGCAGAAGCGCGGCCG<br>TCTGGACCGATGGCTGTGTAGAAGTACTCGCCGATAGT<br>GGAAACCGACGCCCCAGCACTCGTCCGAGGGCAAAGA<br>AATAGAGTAGATGCCGACCGGATCTGTCGATCGACAA<br>GCTCGAGTTTCTCCATAATAATGTGTGAGTAGTTCCCA<br>GATAAGGGAATTAGGGTTCCTATAGGGTTTCGCTCATG<br>TGTTGAGCATATAAGAAACCCTTAGTATGTATTTGTAT<br>TTGTAAAATACTTCTATCAATAAAATTTCTAATTCCTAA<br>AACCAAAATCCAGTACTAAAATCCAGATCaagcttTAATA |

TABLE 5A-continued

Exemplary Sequences comprising SpCas9 for HDR methods

| SEQ ID NO | Name | Sequence |
|---|---|---|
| | | CGTTCGTTCCGATGTAGCTCAGGAACGGGCGCAGAGG<br>CGGATGAATTGGTTGCGGTGGCTATGGATGGTGGAGGT<br>GAACGGCGACGTGCAGCGTCGGTCACAGAGGATCGGA<br>TGGGGCCTGTCGGGATGACCTGTACTATAACGAGGGA<br>GGAGGGGGAGGGAGGAGGGGAAAGAGGAATGTGGGG<br>AAGGCACGTTACCAAGGTTTTGCCAAGAGGCTCTTGTG<br>TTATTCCGGAGGTGTAGCCGAATGGGCGATCCGAGCTA<br>ACGCCAGCTGGGCGTGAGAAGCAGTTGGTCTGAAAGC<br>GGAGGCGGTGCAAGACGGTTCTAAGAAGGAGGCGAAT<br>AAGAAGTGTTTTGTGTGCTGCGGGTGCGAATAGACGGT<br>CACGAGTGGATGGAAGCCGACTTGTAGGCGTGCTGAA<br>AGACGTCGTGCGGGTGCGGTTTTGGTTTTGTGTTGGTC<br>TTGGTAAAAGTGTGCCGCAGGTGAGGGTTCTTGATTGG<br>TGAACGTGAAAACGGATGGCCAAGTCCGAGTCGACCA<br>GAGAGAGAGGCAGAGAGAGAGAGAGAGATGGCTCTTC<br>AGCGCCGCTTCGCGCGTCCTTCACGATTATTCGTGATT<br>ACTGTCCACCGGTCCCTCTTACTCAGAACTGCCGGAAC<br>GAATTCGTGATTTACACCAAACACGCGCTGTCACAGTC<br>ACGAGTCCATGAGCCGTGAGCCCCGCTTCAGATCCTGT<br>TTTCTCTTATTCAGCGTAACAACACAAAACAGAATTTC<br>TTCTAAACACCCTTGCAATTCGCGCACACCCCTGTAGC<br>AGTCTGTCAGCATTCAAAATTCCATTCTACAACggtacCC<br>GTACCGAGCTCGACTTTCACTTTTCTCTATCACTGATAG<br>GGAGTGGTAAACTCGACTTTCATTTTCTCTATCACTGAT<br>AGGGAGTGGTAAACTCGACTTTCACTTTTCTCTATCAC<br>TGATAGGGAGTGGTAAACTCGACTTTCACTTTTCTCTA<br>TCACGGATAGGGAGTGGTAAACTCGACTTTCACTTTTC<br>TCTATCACTGATAGGGAGTGGTAAACTCGACTTTCACT<br>TTTCTCTATCACTGATAGGGAGTGGTAAACTCGACTTT<br>CACTTTTCTCTATCACTGATAGGGAGTGGTAAACTCGA<br>GTACCGAGCTCGACTTTCACTTTTCTCTATCACTGATAG<br>GGAGTGGTAAACTCGACTTTCATTTTCTCTATCACTGAT<br>AGGGAGTGGTAAACTCGACTTTCACTTTTCTCTATCAC<br>TGATAGGGAGTGGTAAACTCGACTTTCACTTTTCTCTA<br>TCACGGATAGGGAGTGGTAAACTCGACTTTCACTTTTC<br>TCTATCACTGATAGGGAGTGGTAAACTCGACTTTCACT<br>TTTCTCTATCACTGATAGGGAGTGGTAAACTCGACTTT<br>CACTTTTCTCTATCACTGATAGGGAGTGGTAAACTCGA<br>GGGGATCAATTCGACCAATGAGGCGCGAGACGAGGGG<br>ACGCTGGAAGTTGAGGCGCAAGAAAATTTTTCTCTGGT<br>TCTGCGCGGCAGAGACGACCAGATTCGCCCGCTTTCTT<br>CTGCGTTGGGTGCCTCTTTTGGGTGCCAGACTTTGTGTG<br>TGCGCCAGCGAGACGTTCCAATAAAGGGCGCTGTCTCG<br>GCACTATCTTTCTTTCTTTCCTCATACATCGTATCATAC<br>CATACACAGACAACATCATCCACGG |
| 655 | pTEF:SpCas9<br>codon-<br>optimised for<br>*Ustilago<br>maydis*<br>mutated, in the<br>plasmid | gatccatgccgcctaagaagaaacgcaaggttgaggataagaagtacagcatcggactcg<br>acatcggtactaactcggtaggatgggcagtcatcacggatgaatacaaggttccttccaag<br>aagtttaaggtccttggtaacaccgacagacattctatcaagaagaacctcattggcgctttg<br>ctctttgactcaggagaaaccgctgaggcgacacgcctcaaacgcacggcacgtcgacgt<br>tatacacgcagaaagaatcgtatctgctatctgcaggaaatcttttcgaacgaaatgcaaa<br>agttgatgacagcttcttccatcgcctggaggaatcgtttctcgtggaggaggacaagaagc<br>acgagagacatcctatcttcggcaacattgtcgatgaggtcgcttaccacgagaagtaccct<br>actatctaccaccttagaaagaagctcgtagactcaactgacaaagcggatcttcgtctgatc<br>tatttggctcttgcccacatgatcaagttccgtggtcattttctcatcgaaggcgaccttaatcc<br>cgacaactcggacgtcgataagctgtttatccagctcgtacagacatacaaccagctcttcg<br>aagaaaacccaattaatgcttccggtgttgatgcaaaagctatcctcagcgcgagattgagc<br>aagagcagacgcctcgaaaacctcatcgcccaattgcctggtgaaaagaagaacggcttg<br>ttcggcaatcttattgccctgagccttggcctcactccgaacttcaagtcgaacttcgatcttg<br>cggaagatgccaagctgcaactctccaaggacacgtacgatgatgacttggacaatctcct<br>tgcccagattggcgatcaatacgccgatctttcctcgcggcgaagaacttgtcggacgcaa<br>tcttgctctcagacatccttcgcgtcaacactgagatcaccaaagcccctctctctgcctcgat<br>gatcaagcgctatgacgaacaccaccaggatctcacgctccttaaggcattggtgcgtcag<br>cagttgcctgagaagtacaaagagattttctttgatcagtcgaagaacggatacgctggcta<br>catcgacggtggcgcttctcaggaggagttctacaagtttatcaaacccattcttgagaagat<br>ggatggcacggaggagctcctcgtcaagctgaatcgcgaggacctcctccgtaagcaac<br>gtacgttcgacaatggctcgattccacaccagattcatctgggcgaactccacgccatcctc<br>aggaggcaggaggacttctatcccttcctcaaggataatcgagagaaaattgagaagatcc<br>tcacattccgcatcccctattatgtaggcccactcgctcgcggaaactctcgctttgcctggat<br>gacccgcaagtcggaagaaacaatcacccgtgaacttcgaagaggtggtggacaagg<br>gtgcatctgcgcagtcgtttattgagaggatgacaaactttgataagaacctcccgaatgag<br>aaagtcctgccaaaacattccctcctgtatgaatacttcacggtctataacgaactgacaaag<br>gtgaagtacgtgaccgagggtatgcgtaagcctgcctttctttcgggtgagcagaagaag<br>ctattgtcgacttgttgttcaagaccaaccgcaaggtcactgtcaagcaactgaaggaagatt<br>acttcaagaaaatcgagtgttttgattcggtagagatctcgggcgtcgaggacaggttcaac<br>gcctctctcggcacctatcacgatcttctcaagatcatcaaggacaaagactttcttgacaac |

TABLE 5A-continued

Exemplary Sequences comprising SpCas9 for HDR methods

| SEQ ID NO | Name | Sequence |
|---|---|---|
| | | gaagagaacgaggatattctcgaggacatcgtgctcaccctcactttgttcgaagatcgcga
aatgattgaggaacgtcttaagacatatgctcacttgttcgacgacaaagtgatgaagcagc
tgaagcgtaggcgatacacaggttggggccgcctctcgcgcaagctgattaacggtatcc
gcgacaagcaatccggcaagacaatcttggatttccttaagagcgacggttttgctaaccgc
aacttcatgcagctcatccacgacgacagccttacgttcaaggaggacatccagaaggcc
caggtttccggacaaggtgactctctccatgagcacatcgctaacctggcgggaagcccc
gcgatcaagaaaggtatcctccagaccgtcaaagttgtggacgagctggtcaaggtaatg
ggccgacacaaaccggagaacattgttatcgagatggcacgagagaatcagacgaccca
gaaaggccaaaagaactccagagaacgtatgaaacgaatcgaagagggtatcaaggaac
tgggatcgcagatcctgaaggagcacccgttgagaacacgcagctccaaaacgaaaag
ctgtacctctactacttgcaaaatggtagggatatgtacgtcgaccaggaactggatattaat
cgtctgtccgactacgacgttgaccacatcgtgcccaatcgtttctcaaggatgactcgatc
gataataaagtacttacgcgctcagacaagaacgaggtaaatcggacaatgtcccatcgg
aggaagtcgtgaagaagatgaagaactattggcgccaacttcttaacgcaaagctgatcac
ccagaggaaattcgacaacctcaccaaagcagaacgcggcggcctctccgagctcgaca
aggctggatttatcaagcgtcagctcgtcgaaacgcgtcagattaccaagcacgtcgcaca
gatcctggatagccgcatgaacacaaagtacgacgaaaacgacaagctcatccgtgaggt
taaggtcatcaccttgaagtcgaaactcgtgtcggacttccgcaaagattttcagttctataaa
gttagagagatcaacaactaccaccatgcgcatgacgcctacctcaatgccgtcgtgggca
ccgcacttattaagaaatacccgaagctcgagtccgagtttgtctacggcgattacaaggtat
acgacgttcgcaagatgattgccaaatcggagcaggagatcggtaaggccactgccaagt
acttctttttactcgaacatcatgaatttcttcaaaacagaaatcaccctcgccaacggcgagat
tcgcaaacgaccactcatcgagactaacggtgaaacgggagagatcgtctgggataagg
gccgagactttgctacggttcgaaaggtcctttcgatgcctcaagtgaacatcgtcaagaaa
acggaggtccaaaccggtggcttcagcaaggagtcgattctgccgaaacgcaattcggac
aaattgattgcacgcaagaaggattgggaccctaagaaatatggcggcttcgattcaccga
cagtggcctattcggttctggtcgtcgcgaaagtggagaagggcaagtcaaagaagctca
agtcagtgaaggagctcctgggaatcaccatcatggaacgttcctcttttgagaagaaccct
atcgactttctcgaggctaagggctacaaagaggtcaagaaagatctcatcatcaaactccc
aaaatactcacttttcgagctcgagaacggccgtaaacgaatgctggcgagcgcaggaga
gcttcaaaagggaaatgaactggctttgccctccaagtacgtcaacttcctctacctcgcaa
gccattatgagaagttgaagggtagccccgaggacaacgaacaaaagcagctcttcgtgg
agcaacacaaacattacctggatgaaatcatcgagcaaatctcggagtttagcaagcgagt
gatcttggctgatgccaacctcgacaaggtgttgtctgcctacaacaagcatcgagataagc
cgattcgcgagcaggccgagaacatcatccacctcttcactctcactaacttgggtgcgcct
gcggcgtttaaatactttgacacgaccatcgaccgcaagcgttacacaagcacgaaggaa
gtcctcgacgctacactgatccatcagtcgatcaccggtctgtacgaaacccgcatcgatct
gtctcaactgggtggtgactcgggtggctacccatacgatgtgcccgattacgctagcggc
ggaaagcgtcccgcagccactaagaaggctggacaggccaagaagaagaagtgagcg
gccgccggctgcagatcgttcaaacatttggcaataaagtttcttaagattgaatcctgttgc
cggtcttgcgatgattatcatataatttctgttgaattacgttaagcatgtaataattaacatgt
aatgcatgacgttatttatgagatgggtttttatgattagagtcccgcaattatacatttaata
cgcgatagaaaacaaaatatagcgcgcaaactaggataaattatcgcgcgcggtgtcatctatgt
tactagatccgatgataagctgtcaaacatgagaattcactggccgtcgttttacaacgtcgtg
actgggaaaaccctggcgttacccaacttaatcgccttgcagcacatccccctttcgccagc
tggcgtaatagcgaagaggcccgcaccgatcgcccttcccaacagttgcgcagcctgaat
ggcgaatggcgcctgatgcggtattttctccttacgcatctgtgcggtatttcacaccgcatat
ggtgcactctcagtacaatctgctctgatgccgcatagttaagccagccccgacacccgcc
aacacccgctgacgcgccctgacgggcttgtctgctcccggcatccgcttacagacaagct
gtgaccgtctccgggagctgcatgtgtcagaggttccaccgtcatcaccgaaacgcgcga
gacgaaagggcctcgtgatacgcctatttggtaccaccttgagaccgaattcgcttactaaaa
gccagataacagtatgcgtatttgcgcgctgattttttgcggtataagaatatatactgatatgta
tacccgaagtatgtcaaaaagaggtgtgctaagcttaggaggtcagctatggagaaaaaa
tcactggatataccaccgttgatatatcccaatggcatcgtaaagaacattttgaggcatttca
gtcagttgctcaatgtacctataaccagaccgttcagctggatattacggcctttttaaagacc
gtaaagaaaaataagcacaagttttatccggcctttattcacattcttgcccgcctgatgaatg
ctcatccggagttccgtatggcaatgaaagacggtgagctggtgatatgggatagtgttcac
ccttgttacaccgttttccatgagcaaactgaaacgttttcatcgctctggagtgaataccacg
acgatttccggcagtttctacacatatattcgcaagatgtggcgtgttacggtgaaaacctgg
cctatttccctaaagggtttattgagaatatgttttcgtctcagccaatccctgggtgagtttc
accagttttgatttaaacgtggccaatatggacaacttcttcgcccccgttttcaccatgggcaa
atattatacgcaaggcgacaaggtgctgatgccgctggcgattcaggttcatcatgccgttt
gtgatggcttccatgtcggcagaatgcttaatgaattacaacagtactgcgatgagtggcag
ggcggggcgtaagagctcaggaggacagctatgcagtttaaggtttacacctataaaaga
gagagccgttatcgtctgtttgtggatgtacagagtgatattattgacacgcccgggcgacg
gatggtgatccccctggccagtgcacgtctgctgtcagataaagtctcccgtgaactttacc
cagtggtgcatatcggggatgaaagctggcgcatgatgaccaccgatatggccagtgtgc
cagtctccgttatcggggaagaagtggctgatctcagccaccgcgaaaatgacatcaaaaa
cgccattaacctgatgttctggggaatataaactagtaggaggtaatcaatgctggccgtcgt
tttacaacgtcgtgactgggaaaaccctggcgttacccaacttaatcgccttgcagcacatc
cccctttcgccagctggcgtaatagcgaagaggcccgcaccgatcgcccttcccaacagtt
gcgcagcctgaatggcgaatggcgcctgatgcggtattttctccttacgcatctgtgcggtat
tcacaccgcatatggtgcactctcagtacaatctgctctgatgccgcatgatcatctggcgg
acctcttcggaggtccgcttttttttctcgagggtctcagtattctagtttcggggaaatgtgcg
cggaacccctatttgtttatttttctaaatacattcaaatatgtatccgctcatgagacaataac
cctgataaatgcttcaataatattaccgatcctcgatctttgtgcaagctagcccgcctcggcag |

TABLE 5A-continued

Exemplary Sequences comprising SpCas9 for HDR methods

| SEQ ID NO | Name | Sequence |
|---|---|---|
| | | caacaaagcagccgagcaagaagcagtacttgccttctgaatcgtgaatgggttacgttctt
caccgctgtgatcagcgaatcatgaatcaaatcatgagggcattgctgatcatgaatcaaat
catgagggcatttaaaaattcagtctgagtcgtgagtagcaagtcggttctggatcggatgg
cattcatgaatcacagggtcgtgaatcatgaatgttcaagtcccctttctcgagaggctggt
gggatcggtgcgaatcacgaatcatgattgtaattcattgagtgaaggagtttcgcagccac
ccacagtactagaatcacgaatgacaatattgaaaaaggaagagtatgagtattcaacatttc
cgtgtcgcccttattcccttttttgcggcattttgccttcctgttttttgctcacccagaaacgct
ggtgaaagtaaaagatgctgaagatcagttgggtgcacgagtgggttacatcgaactggatc
tcaacagcggtaagatccttgagagttttcgccccgaagaacgttttccaatgatgagcactt
ttaaagttctgctatgtggcgcggtattatcccgtattgacgccgggcaagagcaactcggt
cgccgcatacactattctcagaatgacttggttgagtactcaccagtcacagaaaagcatctt
acggatggcatgacagtaagagaattatgcagtgctgccataaccatgagtgataacactg
cggccaacttacttctgacaacgatcggaggaccgaaggagctaaccgcttttttgcacaa
catggggatcatgtaactcgccttgatcgttgggaaccggagctgaatgaagccatacca
aacgacgagcgtgacaccacgatgcctgtagcaatggcaacaacgttgcgcaaactatta
actggcgaactacttactctagcttcccggcaacaattaatagactggatggaggcggataa
agttgcaggaccacttctgcgctcggccctccggctggctggttttattgctgataaatctgg
agccggtgagcgtgggtcacgcggtatcattgcagcactggggccagatggtaagccctc
ccgtatcgtagttatctacacgacggggagtcaggcaactatggatgaacgaaatagacag
atcgctgagataggtgcctcactgattaagcattggtaactgtcagaccaagtttactcatata
tactttagattgatttaaaacttcattttaatttaaaaggatctaggtgaagatcctttttga
taatctcatgaccaaaatcccttaacgtgagttttcgttccactgagcgtcagaccccgtagaaa
agatcaaaggatcttcttgagatcctttttttctgcgcgtaatctgctgcttgcaaacaaaaaaa
ccaccgctaccagcggtggtttgtttgccggatcaagagctaccaactcttttttccgaaggtaa
ctggcttcagcagagcgcagataccaaatactgtccttctagtgtagccgtagtaggccac
cacttcaagaactctgtagcaccgcctacatacctcgctctgctaatcctgttaccagtggct
gctgccagtggcgataagtcgtgtcttaccgggttggactcaagacgatagttaccggataa
ggcgcagcggtcgggctgaacggggggtcgtgcacacagcccagcttggagcgaacg
acctacaccgaactgagatacctacagcgtgagctatgagaaagcgccacgcttcccgaa
gggagaaaggcggacaggtatccggtaagcgcagggtcggaacaggagagcgcacg
agggagcttccaggggaaacgcctggtatctttatagtcctgtcgggtttcgccacctctg
acttgagcgtcgatttttgtgatgctcgtcaggggcggagcctatgaaaaacgccagc
aacgcggccttttacggttcctggccttttgctggccttttgctcacatgttcttcctgcgt
tatcccctgattctgtggataacgtattaccgcctttgagtgagctgataccgctcgccgcagc
cgaacgaccgagcgcagcgagtcagtgagcgaggaagcggaagagcgcccaatacgc
aaaccgcctctccccgcgcgttggccgattcattaatgcagctggcacgacaggtttcccg
actggaaagcgggcagtgagcgcaacgcaattaatgtgagttagctcactcattaggcacc
ccaggctttacactttatgcttccggctcgtatgttgtgtggaattgtgagcggataacaatttc
acacaggaaacagctatgaccatgattacgccaCTATGAGACTTTTCAAC
AAAGGGTAATATCGGGAAACCTCCTCGGATTCCATTGC
CCAGCTATCTGTCACTTCATCAAAAGGACAGTAGAAAA
GGAAGGTGGCACCTACAAATGCCATCATTGCGATAAA
GGAAAGGCTATCGTTCAAGATGCCTCTGCCGACAGTGG
TCCCAAAGATGGACCCCCACCCACGAGGAGCATCGTG
GAAAAAGAAGACGTTCCAACCACGTCTTCAAAGCAAG
TGGATTGATGTGATAACATGGTGGAGCACGACACTCTC
GTCTACTCCAAGAATATCAAAGATACAGTCTCAGAAG
ACCAAAGGGCTATTGAGACTTTTCAACAAAGGGTAAT
ATCGGGAAACCTCCTCGGATTCCATTGCCCAGCTATCT
GTCACTTCATCAAAAGGACAGTAGAAAAGGAAGGTGG
CACCTACAAATGCCATCATTGCGATAAAGGAAAGGCT
ATCGTTCAAGATGCCTCTGCCGACAGTGGTCCCAAAGA
TGGACCCCCACCCACGAGGAGCATCGTGGAAAAAGAA
GACGTTCCAACCACGTCTTCAAAGCAAGTGGATTGATG
TGATATCTCCACTGACGTAAGGGATGACGCACAATCCC
ACTATCCTTCGCAAGACCTTCCTCTATATAAGGAAGTT
CATTTCATTTGGAGAGGACACGCTGAAATCACCAGTCT
CTCTCTACAAATCTATCTCTCTCGAGCTTTCGCAGATCC
CGGGGGGCAATGAGATATGAAAAAGCCTGAACTCACC
GCGACGTCTGTCGAGAAGTTTCTGATCGAAAAGTTCGA
CAGCGTCTCCGACCTGATGCAGCTCTCGGAGGGCGAA
GAATCTCGTGCTTTCAGCTTCGATGTAGGAGGGCGTGG
ATATGTCCTGCGGGTAAATAGCTGCGCCGATGGTTTCT
ACAAAGATCGTTATGTTTATCGGCACTTTGCATCGGCC
GCGCTCCCGATTCCGGAAGTGCTTGACATTGGGGAGTT
TAGCGAGAGCCTGACCTATTGCATCTCCCGCCGTGCAC
AGGGTGTCACGTTGCAAGACCTGCCTGAAACCGAACT
GCCCGCTGTTCTACAACCGGTCGCGGAGGCTATGGATG
CGATCGCTGCGGCCGATCTTAGCCAGACGAGCGGGTTC
GGCCCATTCGGACCGCAAGGAATCGGTCAATACACTA
CATGGCGTGATTTCATATGCGCGATTGCTGATCCCCAT
GTGTATCACTGGCAAACTGTGATGGACGACACCGTCAG
TGCCGTCCGTCGCGCAGGCTCTCGATGAGCTGATGCTTT
GGGCCGAGGACTGCCCCGAAGTCCGGCACCTCGTGCA
CGCGGATTTCGGCTCCAACAATGTCCTGACGGACAATG
GCCGCATAACAGCGGTCATTGACTGGAGCGAGGCGAT |

TABLE 5A-continued

Exemplary Sequences comprising SpCas9 for HDR methods

| SEQ ID NO | Name | Sequence |
|---|---|---|
| | | GTTCGGGGATTCCCAATACGAGGTCGCCAACATCTTCT<br>TCTGGAGGCCGTGGTTGGCTTGTATGGAGCAGCAGACG<br>CGCTACTTCGAGCGGAGGCATCCGGAGCTTGCAGGATC<br>GCCACGACTCCGGGCGTATATGCTCCGCATTGGTCTTG<br>ACCAACTCTATCAGAGCTTGGTTGACGGCAATTTCGAT<br>GATGCAGCTTGGGCGCAGGGTCGATGCGACGCAATCG<br>TCCGATCCGGAGCCGGGACTGTCGGGCGTACACAAAT<br>CGCCCGCAGAAGCGCGGCCGTCTGGACCGATGGCTGT<br>GTAGAAGTACTCGCCGATAGTGGAAACCGACGCCCCA<br>GCACTCGTCCGAGGGCAAAGAAATAGAGTAGATGCCG<br>ACCGGATCTGTCGATCGACAAGCTCGAGTTTCTCCATA<br>ATAATGTGTGAGTAGTTCCCAGATAAGGGAATTAGGGT<br>TCCTATAGGGTTTCGCTCATGTGTTGAGCATATAAGAA<br>ACCCTTAGTATGTATTTGTATTTGTAAAATACTTCTATC<br>AATAAAATTTCTAATTCCTAAAACCAAAATCCAGTACT<br>AAAATCCAGATCagcttggtacCCGTACCGAGCTCGACTTTC<br>ACTTTTCTCTATCACTGATAGGGAGTGGTAAACTCGAC<br>TTTCATTTTCTCTATCACTGATAGGGAGTGGTAAACTC<br>GACTTTCACTTTTCTCTATCACTGATAGGGAGTGGTAA<br>ACTCGACTTTCACTTTTCTCTATCACGGATAGGGAGTG<br>GTAAACTCGACTTTCACTTTTCTCTATCACTGATAGGG<br>AGTGGTAAACTCGACTTTCACTTTTCTCTATCACTGATA<br>GGGAGTGGTAAACTCGACTTTCACTTTTCTCTATCACT<br>GATAGGGAGTGGTAAACTCGAGTACCGAGCTCGACTTT<br>CACTTTTCTCTATCACTGATAGGGAGTGGTAAACTCGA<br>CTTTCATTTTCTCTATCACTGATAGGGAGTGGTAAACTC<br>GACTTTCACTTTTCTCTATCACTGATAGGGAGTGGTAA<br>ACTCGACTTTCACTTTTCTCTATCACGGATAGGGAGTG<br>GTAAACTCGACTTTCACTTTTCTCTATCACTGATAGGG<br>AGTGGTAAACTCGACTTTCACTTTTCTCTATCACTGATA<br>GGGAGTGGTAAACTCGACTTTCACTTTTCTCTATCACT<br>GATAGGGAGTGGTAAACTCGAGGGGATCAATTCGACC<br>AATGAGGCGCGAGACGAGGGGACGCTGGAAGTTGAGG<br>CGCAAGAAAATTTTTCTCTGGTTCTGCGCGGCAGAGAC<br>GACCAGATTCGCCCGCTTTCTTCTGCGTTGGGTGCCTCT<br>TTTGGGTGCCAGACTTTGTGTGTGCGCCAGCGAGACGT<br>TCCAATAAAGGGCGCTGTCTCGGCACTATCTTTCTTTCT<br>TTCCTCATCATCGTATCATACCATACACAGACAACAT<br>CATCCACGG |
| 656 | p35S:SpCas9 codon-optimised for *Agaricus bisporus* iin the plasmid | gacgaaagggcctcgtgatacgcctattttttataggttaatgtcatgataataatggtttcttag<br>acgtcaggtggcacttttcggggaaatgtgcgcggaaccccctattgttttattttttctaaataca<br>ttcaaatatgtatccgctcatgagacaataaccctgataaatgcttcaataatattgaaaaagg<br>aagagtatgagtattcaacatttccgtgtcgcccttattccctttttttgcggcattttgccttcc<br>tgttttgctcacccagaaacgctggtgaaagtaaaagatgctgaagatcagttgggtgcacga<br>gtgggttacatcgaactggatctcaacagcggtaagatccttgacagtggcgccccgaaga<br>acgttttccaatgatgagcacttttaaagttctgctatgtggcgcggtattatcccgtattgacg<br>ccgggcaagagcaactcggtcgccgcatacactattctcagaatgacttggttgagtactca<br>ccagtcacagaaaagcatcttacggatggcatgacagtaagagaattatgcagtgctgcca<br>taaccatgagtgataacactgcggccaacttacttctgacaacgatcggaggaccgaagga<br>gctaaccgcttttttgcacaacatggggggatcatgtaactcgccttgatcgttgggaaccgga<br>gctgaatgaagccataccaaacgacgagcgtgacaccacgatgcctgtagcaatggcaa<br>caacgttgcgcaaactattaactggcgaactacttactctagcttcccggcaacaattaatag<br>actggatggaggcggataaagttgcaggaccacttctgcgctcggcccttccggctggctg<br>gtttattgctgataaatctggagccggtgagcgtggatctgcggtatcattgcagcactgg<br>ggccagatggtaagccctcccgtatcgtagttatctacacgacggggagtcaggcaactat<br>ggatgaacgaaatagacagatcgctgagataggtgcctcactgattaagcattggtaactgt<br>cagaccaagtttactcatatatactttagattgatttaaaacttcatttttaatttaaaaggatct<br>aggtgaagatccttttttgataatctcatgaccaaaatcccttaacgtgagttttcgttccactgagc<br>gtcagaccccgtagaaaagatcaaaggatcttcttgagatcctttttttctgcgcgtaatctgct<br>gcttgcaaacaaaaaaaccaccgctaccagcggtggtttgtttgccggatcaagagctacc<br>aactcttttccgaaggtaactggcttcagcagagcgcagataccaaatactgttcttctagtg<br>tagccgtagttaggccaccacttcaagaactctgtagcaccgcctacatacctcgctctgcta<br>atcctgttaccagtggctgctgccagtggcgataagtcgtgtcttaccggggttggactcaag<br>acgatagttaccggataaggcgcagcggtcgggctgaacggggggttcgtgcacacagc<br>ccagcttggagcgaacgacctacaccgaactgagatacctacagcgtgagctatgagaaa<br>gcgccacgcttcccgaagggagaaaggcggacaggtatccggtaagcggcagggtcgg<br>aacaggagagcgcacgagggagcttccaggggaaacgcctggtatctttatagtcctgt<br>cgggtttcgccacctctgacttgagcgtcgatttttgtgatgctcgtcagggggcggagcc<br>tatgaaaaacgccagcaacgcggccttttacggttcctggccttttgctggccttttgctca<br>catgttctttcctgcgttatcccctgattctgtggataaccgtattaccgcctttgagtgagctga<br>taccgctcgccgcagccgaacgaccgagcgcagcgagtcagtgagcgaggaagcgga<br>agagcgcccaatacgcaaaccgcctctccccgcgcgttggccgattcattaatgcagctgg<br>cacgacaggtttcccgactggaaagcgggcagtgagcgcaacgcaattaatgtgagttag<br>ctcactcattaggcaccccaggctttacactttatgcttccggctcgtatgttgtgtggaattgt<br>gagcggataacaatttcacacaggaaacagctatgaccatgattacgccaagcttgcatgc |

TABLE 5A-continued

Exemplary Sequences comprising SpCas9 for HDR methods

| SEQ ID NO | Name | Sequence |
|---|---|---| aggcctctgcagtcgacgggcccgggatccgataacaggtctcatagtTGAGACTT
TTCAACAAAGGGTAATATCGGGAAACCTCCTCGGATTC
CATTGCCCAGCTATCTGTCACTTCATCAAAAGGACAGT
AGAAAAGGAAGGTGGCACCTACAAATGCCATCATTGC
GATAAAGGAAAGGCTATCGTTCAAGATGCCTCTGCCG
ACAGTGGTCCCAAAGATGGACCCCCACCCACGAGGAG
CATCGTGGAAAAGAAGACGTTCCAACCACGTCTTCA
AAGCAAGTGGATTGATGTGATAACATGGTGGAGCACG
ACACTCTCGTCTACTCCAAGAATATCAAAGATACAGTC
TCAGAAGACCAAAGGGCTATTGAGACTTTTCAACAAA
GGGTAATATCGGGAAACCTCCTCGGATTCCATTGCCCA
GCTATCTGTCACTTCATCAAAAGGACAGTAGAAAAGG
AAGGTGGCACCTACAAATGCCATCATTGCGATAAAGG
AAAGGCTATCGTTCAAGATGCCTCTGCCGACAGTGGTC
CCAAAGATGGACCCCCACCCACGAGGAGCATCGTGGA
AAAAGAAGACGTTCCAACCACGTCTTCAAAGCAAGTG
GATTGATGTGATATCTCCACTGACGTAAGGGATGACGC
ACAATCCCACTATCCTTCGCAAGACCTTCCTCTATATA
AGGAAGTTCATTTCATTTGGAGAGGACACGCTGAAATC
ACCAGTCTCTCTCTACAAATCTATCTCTCGAGCTTTC
GCAGATCCCGGGGGGCAATGAGATatggataagaagtactctatcg
gcctcgatatcggtaccaactctgtcggttgggctgtcatcaccgatgaatacaaggtcccttc
taagaagttcaaggtcctcggtaacaccgatcgtcattctatcaagaagaacctcatcggt
gctctcctcttcgattctggtgaaaccgctgaagctacccgtctcaagcgtaccgctcgtcgt
cgttacacccgtcgtaagaaccgtatctgctacctccaagaaatcttctctaacgaaatggct
aaggtcgatgattcttcttccatcgtctcgaagaatctttcctcgtcgaagaagataagaagc
atgaacgtcatcctatcttcggtaacatcgtcgatgaagtcgcttaccatgaaaagtaccta
ccatctaccatctccgtaagaagctcgtcgattctaccgataaggctgatctccgtctcatcta
cctcgctctcgctcatatgatcaagttccgtggtcatttcctcatcgaaggtgatctcaaccct
gataactctgatgtcgataagctcttcatccaactcgtccaaacctacaaccaactcttcgaa
gaaaacccatcaacgcttctggtgtcgatgctaaggctatcctctctgctcgtctctctaagt
ctcgtcgtctcgaaaacctcatcgctcaactccctggtgaaaagaagaacggcctcttcggt
aacctcatcgctctctctctcggcctcaccctaacttcaagtctaacttcgatctcgctgaag
atgctaagctccaactctctaaggatacctacgatgatgatctcgataacctcctcgctcaaat
cggtgatcaatacgctgatctcttcctcgctgctaagaacctctctgatgctatcctcctctctg
atatcctccgtgtcaacaccgaaatcaccaaggctcctctctctgcttctatgatcaagcgtta
cgatgaacatcatcaagatctcacctcctcaaggctctcgtccgtcaacaactccctgaaa
agtacaaggaaatcttcttcgatcaatctaagaacggttacgctggttacatcgatggtggtg
cttctcaagaagaattctacaagttcatcaagcctatcctcgaaaagatggatggtaccgaa
gaactcctcgtcaagctcaaccgtgaagatctcctccgtaagcaacgtaccttcgataacgg
ttctatccctcatcaaatccatctcggtgaactccatgctatcctccgtgtcaagaagatttct
acccttcctcaaggataaccgtgaaaagatcctcaccttccgtatccccttact
acgtcggtcctctcgctcgtggtaactctcgtttcgcttggatgacccgtaagtctgaagaaa
ccatcaccccttggaacttcgaagaagtcgtcgataagggtgcttctgctcaatctttcatcg
aacgtatgaccaacttcgataagaacctccctaacgaaaaggtcctccctaagcattctctcc
tctacgaatacttcaccgtctacaacgaactcaccaaggtcaagtacgtcaccgaaggtatg
cgtaagcctgcttttcctctctggtgaacaaaagaaggctatcgtcgatctcctcttcaagacc
aaccgtaaggtcaccgtcaagcaactcaaggaagattacttcaagaagatcgaatgcttcg
attctgtcgaaatctctggtgtcgaagatcgtttcaacgcttctctcggtacctaccatgatctc
ctcaagatcatcaaggataaggatttcctcgataacgaagaaaacgaagatatcctcgaag
atatcgtcctcaccctcaccctcttcgaagatcgtgaaatgatcgaagaacgtctcaagacct
acgctcatctcttcgatgataaggtcatgaagcaactcaagcgtcgtcgttacaccggttgg
ggtcgtctctctcgtaagctcatcaacggtatccgtgataagcaatctggtaagaccatcctc
gatttcctcaagtctgatggtttcgctaaccgtaacttcatgcaactcatccatgatgattctctc
accttcaaggaagatatccaaaaggctcaagtctctgagtgcaagaagggttctctccatgaacat
atcgctaacctcgctggttctcctgctatcaagaagggtatcctccaaaccgtcaaggtcgtc
gatgaactcgtcaaggtcatgggtcgtcataagcctgaaaacatcgtcatcgaaatggctcg
tgaaaaccaaaccacccaaaagggtcaaaagaactctcgtgaacgtatgaagcgtatcga
agaaggtatcaaggaactcggttctcaaatcctcaaggaacatcctgtcgaaaacacccaa
ctccaaaacgaaaagctctacctctactacctccaaaacggtcgtgatatgtacgtcgatca
agaactcgatatcaaccgtctctctgattacgatgtcgatcatatcgtccctcaatctttcctca
aggatgattctatcgataacaaggtcctcacccgttctgataagaaccgtggtaagtctgata
acgtccctctgaagaagtcgtcaagaagatgaagaactactgcgtcaactcctcaacgct
aagctcatcacccaacgtaagttcgataacctcaccaaggctgaacgtggtggcctctctga
actcgataaggctggtttcatcaagcgtcaactcgtcgaaacccgtcaaatcaccaagcatg
tcgctcaaatcctcgattctcgtatgaacaccaagtacgatgaaaacgataagctcatccgtg
aagtcaaggtcatcacccctcaagtctaagcgtgtctcttgatttccgtaaggatttccaattctac
aaggtccgtgaaatcaacaactaccatcatgctcatgatgcttacctcaacgctgtcgtcggt
accgctctcatcaagaagtaccctaagctcgaatctgaattcgtctacggtgattacaaggtc
tacgatgtccgtaagatgatcgctaagtctgaacaagaaatcggtaaggctaccgctaagta
cttcttctactctaacatcatgaacttcttcaagaccgaaatcacccctcgctaacggtgaaatc
cgtaagcgtcctctcatcgaaaccaacggtgaaaccggtgaaatcgtctgggataaggctg
gtgatttcgctaccgtccgtaaggtcctctctatgcctcaagtcaacatcgtcaagaagaccg
aagtccaaaccggtggtttctctaaggaatctatcctccctaagcgtaactctgataagctcat
cgctcgtaagaaggattgggatcctaagaagtacggtggtttcgattctcctaccgtcgctta
ctctgtcctcgtcgtcgctaaggtcgaaaagggtaagtctaagaagctcaagtctgtcaagg TABLE 5A-continued Exemplary Sequences comprising SpCas9 for HDR methods

| SEQ ID NO | Name | Sequence |
|---|---|---|
| | | aactcctcggtatcaccatcatggaacgttcttctttcgaaaagaaccctatcgatttcctcga<br>agctaagggttacaaggaagtcaagaaggatctcatcatcaagctccctaagtactctctctt<br>cgaactcgaaaacggtcgtaagcgtatgctcgcttctgctggtgaactccaaagggtaac<br>gaactcgctctcccttctaagtacgtcaacttcctctacctcgcttctcattacgaaaagctcaa<br>gggttctcctgaagataacgaacaaaagcaactcttcgtcgaacaacataagcattacctcg<br>atgaaatcatcgaacaaatctctgaattctctaagcgtgtcatcctcgctgatgctaacctcga<br>taaggtcctctctgcttacaacaagcatcgtgataagcctatccgtgaacaagctgaaaacat<br>catccatctcttcaccctcaccaacctcggtgctcctgctgctttcaagtacttcgataccacc<br>atcgatcgtaagcgttacacctctaccaaggaagtcctcgatgctaccctcatccatcaatct<br>atcaccggcctctacgaaacccgtatcgatctctcaactcggtggtgatggtatccatggt<br>gtccctgctgctcctaagaagaagcgtaagcctaagaagaagcgtaagcctaagaagaag<br>cgtaagtaaagtagatgccgaccggatctgtcgatcgacaagctcgagtttctccataataat<br>gtgtgagtagttcccagataagggaattagggttcctataggtttcgctcatgtgttgagcat<br>ataagaaacccttagtatgtatttgtatttgtaaaatacttctatcaataaaatttctaattccta<br>accaaaatccagtactaaaatccagatcgagctcgcagtgagacctgttatctagatgcattc<br>aagcgaggtaccgagctcgaattcactggccgtcgttttacaacgtcgtgactgggaaaccc<br>tggcgttacccaacttaatcgccttgcagcacatccccctttcgccagctggcgtaatagcg<br>aagaggcccgcaccgatcgcccttcccaacagttgcgcagcctgaatggcgaatggcgc<br>ctgatgcggtattttctccttacgcatctgtgcggtatttcacaccgcatatggtgcactctcag<br>tacaatctgctctgatgccgcatagttaagccagccccgacacccgccaacacccgctgac<br>gcgccctgacgggcttgtctgctcccggcatccgcttacagacaagctgtgaccgtctccg<br>ggagctgcatgtgtcagaggttttcaccgtcatcaccgaaacgcgcga |
| 657 | SpCas9 codon-<br>optimised for<br>*Agaricus<br>bisporus* with<br>TrpC<br>terminator,<br>mutated, CDS<br>sequence | tcgcgcgtttcggtgatgacggtgaaaacctctgacacatgcagctcccggagacggtcac<br>agcttgtctgtaagcggatgccgggagcagacaagcccgtcagggcgcgtcagcgggtg<br>ttggcgggtgtcggggctggcttaactatgcggcatcagagcagattgtactgagagtgca<br>ccatatgcggtgtgaaataccgcacagatgcgtaaggagaaaataccgcatcaggcgcca<br>ttcgccattcaggctgcgcaactgttgggaagggcgatcggtgcgggcctcttcgctattac<br>gccagctggcgaaaggggatgtgctgcaaggcgattaagttgggtaacgccagggtttt<br>cccagtcacgacgttgtaaaacgacggccagtgaattcgagctcggtacctcgcgaatgc<br>atctagataacaggtctcaaacaatggataagaagtactctatcggcctcgatatcggtacc<br>aactctgtcggttgggctgtcatcaccgatgaatacaaggtcccttctaagaagttcaaggtc<br>ctcggtaacaccgatcgtcattctatcaagaagaacctcatcggtgctctcctcttcgattctg<br>gtgaaaccgctgaagctacccgtctcaagcgtaccgtcgtcgttacaccgtcggaa<br>gaaccgtatctgctacctccaagaaatattctcgaacgaaatggctaaagtcgatgattctttc<br>ttccatcgtctcgaagaatctttcctcgtcgaagaagataagaagcatgaacgtcatcctatct<br>tcggtaacatcgtcgatgaagtcgcttaccatgaaaagtaccctaccatctaccatctccgta<br>agaagctcgtcgattctaccgataaggctgatctccgtctcatctacctcgctctcgctcatat<br>gatcaagttccgtggtcatttcctcatcgaaggtgatctcaaccctgataactctgatgtcgat<br>aagctcttcatccaactcgtccaaacctacaaccaactcttcgaagaaaacccctatcaacgct<br>tctggtgtcgatgctaaggctatcctctctgctcgtctctctaagtctcgtcgtctcgaaaacct<br>catcgctcaactccctggtgaaaagaagaacggcctcttcggtaactcatcgctctctctct<br>cggcctcacccctaacttcaagtctaacttcgatctcgctgaagatgctaagctccaactctct<br>aaggatacctacgatgatgatctcgataacctcctcgctcaaatcggtgatcaatacgctgat<br>ctcttcctcgctgctaagaacctctctgatgctatcctcctctctgatatcctccgtgtcaacac<br>cgaaatcaccaaggctcctctctctgcttctatgatcaagcgttacgatgaacatcatcaaga<br>tctcacccctcctcaaggctctcgtccgtcaacaactccctgaaaagtacaaggaaatcttctt<br>cgatcaatctaagaacggttacgctggttacatcgatggtggtgcttctcaagaagaattcta<br>caagttcatcaagcctatcctcgaaaagatggatggtaccgaagaactcctcgtcaagctca<br>accgtgaagatctcctccgtaagcaacgtacctttcgataacggttctatccctcatcaaatct<br>atctcggtgaactccatgctatcctccgtcgtcaagaagatttctaccctttcctcaaggataa<br>ccgtgaaaagatcgaaaagatcctcaccttccgtatcccttactacgtcggtcctctcgctcg<br>tggtaactctcgtttcgcttggatgaccgtaagtctgaagaaaccatcacccccttggaactt<br>cgaagaagtcgtcgataagggtgcttctgctcaatctttcatcgaacgtatgaccaacttcga<br>taagaacctcccctaacgaaaaggtcctccctaagcattctctcctctacgaatacttcaccgt<br>ctacaacgaactcaccaaggtcaagtacgtcaccgaaggtatgcgtaagcctgcttcctct<br>ctggtgaacaaaagaaggctatcgtcgatctcctcttcaagaccaaccgtaaggtcaccgtc<br>aagcaactcaaggaagattacttcaagaagatcgaatgcttcgattctgtcgaaatctctggt<br>gtcgaagatcgtttcaacgcttctctcggtacctaccatgatctcctcaagatcatcaaggata<br>aggattcctcgataacgaagaaaacgaagatatcctcgaagatatcgtcctcaccctcacc<br>ctcttcgaagatcgtgaaatgatcgaagaacgtctcaagacctacgctcatctcttcgatgat<br>aaggtcatgaagcaactcaagcgtcgtcgttacaccggttggggtcgtctctctcgtaagct<br>catcaacggtatccgtgataagcaatctggcaagaccatcctggactttctgaagtctgatg<br>gtttcgcgaaccgtaacttcatgcaactcatccacgacgattcgctaacgttcaaagaagata<br>tccaaaaggctcaagtctctggtcaaggtgattctctccatgaacatatcgctaacctcgctg<br>gttctcctgctatcaagaagggtatcctccaaaccgtcaaggtcgtcgatgaactcgtcaag<br>gtcatgggtcgtcataagcctgaaaacctcgtcatcgaaatggctcgtgaaaaccaaacca<br>cccaaaagggtcaaaagaactctcgtgaacgtatgaagcgtatcgaagaaggtatcaagg<br>aactcggttctcaaatcctcaaggaacatcctgtcgaaaacacccaactccaaaacgaaaa<br>gctctacctctactacctccaaaacggtcgtgatatgtacgtcgatcaagaactcgatatcaa<br>ccgtctatcggattacgatgtcgatcatatcgtgccacaatcgttctcaaagatgattctatc<br>gataacaaggtcctcacccgttctgataagaaccgtggtaagtctgataacgtcccttctgaa<br>gaagtcgtcaagaagatgaagaactactggcgtcaactcctcaacgctaagctcatcaccc<br>aacgtaagttcgataacctcaccaaggctgaacgtggtggcctctctgaactcgataaggct<br>ggtttcatcaagcgtcaactcgtcgaaacccgtcaaatcaccaagcatgtcgctcaaatcct<br>cgattctcgtatgaacaccaagtacgatgaaaacgataagctcatccgtgaagtcaaggtca |

TABLE 5A-continued

Exemplary Sequences comprising SpCas9 for HDR methods

| SEQ ID NO | Name | Sequence |
|---|---|---|
| | | tcaccctcaagtctaagctcgtctctgatttccgtaaggatttccaattctacaaggtccgtga
aatcaacaactaccatcatgctcacgacgcttacctcaacgctgtcgtcggtacggcactga
tcaaaaagtacccctaagctcgaatctgaattcgtctacggtgattacaaggtctacgatgtcc
gtaagatgatcgctaagtctgaacaagaaatcggcaaggctacggctaagtacttcttctact
cgaacatcatgaacttcttcaaaaccgaaatcaccctcgctaacggtgaaatccgtaagcgt
cctctcatcgaaaccaacggtgaaaccggtgaaatcgtctgggataagggtcgtgatttcg
ctaccgtccgtaaggtcctctctatgcctcaagtcaacatcgtcaagaagaccgaagtccaa
accggtggtttctctaaggaatctatcctccctaagcgtaactctgataagctcatcgctcgta
agaaggattgggatcctaagaagtacggtggtttcgattctcctaccgtcgcttactctgtcct
cgtcgtcgctaaggtcgaaaagggtaagtctaagaagctcaagtctgtcaaggaactcctc
ggtatcaccatcatggaacgttcttctttcgaaaagaacctatcgatttcctcgaagctaagg
gttacaaggaagtcaagaaggatctcatcatcaagctccctaagtactctctcttcgaactcg
aaaacggtcgtaagcgtatgctcgctcttctgctggtgaactccaaaagggtaacgaactcgct
ctccctcctaaaatacgtcaacttcctgtacctggcttcgcattacgaaaagctcaagggttcgc
cagaggataacgaacaaaagcaactcttcgtcgaacaacataagcattacctcgatgaaat
catcgaacaaatctctgaattctctaagcgtgtcatcctcgctgatgctaacctcgataaggtc
ctctctgcttacaacaagcatcgtgataagctcatccgtgaacaagctgaaaacatcatccat
ctcttcaccctcaccaacctcggtgctcctgctgcttttcaagtacttcgataccaccatcgatc
gtaagcgttacacctctaccaaggaagtcctcgatgctaccctcatccatcaatctatcaccg
gcctctacgaaacccgtatcgatctctctcaactcggtggtgatggtatccatggtgtccctg
ctgctcctaagaagaagcgtaagcctaagaagaagcgtaagcctaagaagaagcgtaagt
aaagtagatgccgaccggatctgtcgatcgacaagctcgagcggccgcagtagatgccg
accgggatccacttaacgttactgaaatcatcaaacagcttgacgaatctggatataagatc
gttggtgtcgatgtcagctccggagttgagacaaatggtgttcaggatctcgataagtacg
ttcatttgtccaagcagcaaagagtgccttctagtgatttaatagctccatgtcaacaagaata
aaacgcgtttcgggtttaccctcttccagatacagcctcatctgcaatgcattaatgcattggacc
tcgcaaccctagtacgcccttcaggctccggcgaagcagaagaatagcttagcagagtcta
ttttcattttcgggagacgagatcaagcagatcaacggtcgtcaagagacctacgagactga
ggaatccgctcttggctccacgcgactatatatttgtctctaattgtactttgacatgctcctctt
ctttactctgatagcttgactatgaaaattccgtcaccagccctgggttcgcaaagataattg
cactgtttcttccttgaactctcaagcctacaggacacacattcatcgtaggtataaacctcga
aaatcattcctactaagatgggtatacaatagtaaccatgcatggttgcctagtgaatgctcc
gtaacacccaatacgccggccgaaacttttttacaactctcctatgagtcgtttacccagaat
gcacaggtacacttgtttagaggtaatccttctttctagaagtcctcgtgtactgtgtaagcgc
ccactccacatctccactcgagctagctagggcttgagacctgttatcggatcccgggcc
gtcgactgcagaggcctgcatgcaagcttggcgtaatcatggtcatagctgtttcctgtgtga
aattgttatccgctcacaattccacacaacatacgagccggaagcataaagtgtaaagcctg
gggtgcctaatgagtgagctaactcacattaattgcgttgcgctcactgcccgctttccagtc
gggaaacctgtcgtgccagctgcattaatgaatcggccaacgcgcggggagaggcggttt
gcgtattgggcgctcttccgcttcctcgctcactgactcgctgcgctcggtcgttcggctgcg
gcgagcggtatcagctcactcaaaggcggtaatacggttatccacagaatcaggggataa
cgcaggaaagaacatgtgagcaaaaggccagcaaaaggccaggaaccgtaaaaaggc
cgcgttgctggcgtttttccataggctccgcccccctgacgagcatcacaaaaatcgacgct
caagtcagaggtggcgaaacccgacaggactataaagataccaggcgtttccccctggaa
gctccctcgtgcgctctcctgttccgaccctgccgcttaccggatacctgtccgcctttctccc
ttcgggaagcgtggcgctttctcatagctcacgctgtaggtatctcagttcggtgtaggtcgtt
cgctccaagctgggctgtgtgcacgaaccccccgttcagcccgaccgctgcgccttatcc
ggtaactatcgtcttgagtccaacccggtaagacacgacttatcgccactggcagcagcca
ctggtaacaggattagcagagcgaggtatgtaggcggtgctacagagttcttgaagtggtg
gcctaactacggctacactagaagaacagtatttggtatctgcgctctgctgaagccagttac
cttcggaaaaagagttggtagctcttgatccggcaaacaaaccaccgctggtagcggtggt
ttttttgtttgcaagcagcagattacgcgcagaaaaaaggatctcaagaagatcctttgatct
tttctacggggtctgacgctcagtggaacgaaaactcacgttaagggattttggtcatgagat
tatcaaaaaggatcttcacctagatccttttaaattaaaaatgaagttttaaatcaatctaaagta
tatatgagtaaacttggtctgacagttaccaatgcttaatcagtgaggcacctatctcagcgat
ctgtctatttcgttcatccatagttgcctgactccccgtcgtgtagataactacgatacgggag
ggcttaccatctggccccagtgctgcaatgataccgcgagatccacgctcaccggctccag
atttatcagcaataaaccagccagccggaagggccgagcgcagaagtggtcctgcaactt
tatccgcctccatccagtctattaattgttgccgggaagctagagtaagtagttcgccagttaa
tagtttgcgcaacgttgttgccattgctacaggcatcgtggtgtcacgctcgtcgtttggtatg
gcttcattcagctccggttcccaacgatcaaggcgagttacatgatccccatgttgtgcaaa
aaagcggttagctccttcggtcctccgatcgttgtcagaagtaagttggccgcagtgttatca
ctcatggttatggcagcactgcataattctcttactgtcatgccatccgtaagatgcttttctgtg
actggtgagtactcaaccaagtcattctgagaatagtgtatgcggcgaccgagttgctcttgc
ccggcgtcaatacgggataataccgcgccacatagcagaactttaaaagtgctcatcattg
gaaaacgttcttcggggcgaaaactctcaaggatcttaccgctgttgagatccagttcgatgt
aacccactcgtgcacccaactgatcttcagcatcttttactttcaccagcgtttctgggtgagc
aaaaacaggaaggcaaaatgccgcaaaaaagggaataagggcgacacggaaatgttga
atactcatactcttcctttttcaatattattgaagcatttatcagggttattgtctcatgagcgga
tacatatttgaatgtatttagaaaaataaacaaataggggttccgcgcacatttccccgaaaagt
gccacctgacgtctaagaaaccattattatcatgacattaacctataaaaataggcgtatcac
gaggccctttcgtc |

TABLE 5B

Exemplary Cas sequences

| SEQ ID NO: | Name | Sequence |
|---|---|---|
| 200 | Optimized 3x FLAG tag | gattataaagatcatgatggagattataaagatcatgatatcgattataaagatgatg atgataaagcagca |
| 201 | NLS | ccaaaaaaaaaagaaaagtcggaatccatggagtcccagcagca |
| 202 | Linker-NLS | ggaatccatggagtcccagcagcaccaaaaaaaaaagaaaagtctga |
| 742 | Codon optimized Cas9 nuclease | gataaaaaatattcaatcggattggatatcggaacaaactcagtcggatgggcagt catcacagatgaatataaagtcccatcaaaaaaattcaaagtcttgggaaacacag atagacattcaatcaaaaaaaacttgatcggagcattgttgttcgattcaggagaaa cagcagaagcaacaagattgaaaagaacagcaagaagaagatatacaagaaga aaaaacagaatctgctatttgcaagaaatcttctcaaacgaaatggcaaaagtcgat gattcattcttccatagattggaagaatcattcttggtcgaagaagataaaaaacatg aaagacatccaatcttcggaaacatcgtcgatgaagtcgcatatcatgaaaaatatc caacaatctatcatttgagaaaaaaattggtcgattcaacagataaagcagatttgag attgatctatttggcattggcacatatgatcaaattcagaggacatttcttgatcgaag gagatttgaacccagataactcagatgtcgataaaattgttcatccaattggtccaaac atataaccaattgttcgaagaaaacccaatcaacgcatcaggagtcgatgcaaaag caatcttgtcagcaagattgtcaaaatcaagaagattggaaaacttgatcgcacaatt gccaggagaaaaaaaaaacggattgttcggaaacttgatcgcattgtcattgggatt gacaccaaacttcaaatcaaacttcgatttggcagaagatgcaaaattgcaattgtc aaaagatacatatgatgatgatttggataacttgttggcacaaatcggagatcaatat gcagatttgttcttggcagcaaaaaacttgtcagatgcaatcttgttgtcagatatctt gagagtcaacacagaaatcacaaaagcaccattgtcagcatcaatgatcaaaaga tatgatgaacatcatcaagatttgacattgttgaaagcattggtcagacaacaattgc cagaaaaatataaagaaatcttcttcgatcaatcaaaaaacggatatgcaggatata tcgatggaggagcatcacaagaagaattctataaattcatcaaaccaatcttggaaa aaatggatggaacagaagaattgttggtcaaattgaacagagagattttgttgaga aaacaaagaacattcgataacggatcaatcccacatcaaatccatttgggagaattg catgcaatcttgagaagacaagaagatttctatccattcttgaaagataacagagaa aaaatcgaaaaatcttgacattcagaatcccatattatgtcggaccattggcaaga ggaaactcaagattcgcatggatgacaagaaaatcagaagaaacaatcacaccat ggaacttcgaagaagtcgtcgataaaggagcatcagcacaatcattcatcgaaag aatgacaaacttcgataaaaacttgccaaacgaaaaagtcttgccaaaacattcatt gttgtatgaatatttcacagtctataacgaattgacaaaagtcaaatatgtcacagaa ggaatgagaaaaccagcattcgtcaggagaacaaaaaaagcaatcgtcgattt gttgttcaaaacaaacagaaaagtcacagtcaaacaattgaaagaagattatttcaa aaaaatcgaatgcttcgattcagtcgaaatctcaggagtcgaagatagattcaacgc atcattgggaacatatcatgatttgttgaaaatcatcaaagataaagatttcttggata acgaagaaaacgaagatatcttggaagatatcgtcttgacattgacattgttcgaag atagagaaatgatcgaagaaagattgaaaacatatgcacatttgttcgatgataaag tcatgaaacaattgaaaagaagaagatatacaggatggggaagattgtcaagaaa attgatcaacggaatcagagataaacaatcaggaaaaacaatcttggatttcttgaa atcagatggattcgcaaacagaaacttcatgcaattgatccatgatgattcattgaca ttcaaagaagatatccaaaaagcacaagtctcaggacaaggagattcattgcatga acatatcgcaaacttggcaggatcaccagcaatcaaaaaaggaatcttgcaaaca gtcaaagtcgtcgatgaattggtcaaagtcatgggaagacataaaccagaaaacat cgtcatcgaaatggcaagagaaaaccaaacaacacaaaaggacaaaaaaactc aagagaaagaatgaaaagaatcgaagaaggaatcaaagaatgggatcacaaat cttgaaagaacatccagtcgaaaacacacaattgcaaaacgaaaaattgtatttgta ttatttgcaaaacggaagagatatgtatgtcgatcaagaattggatatcaacagattg tcagattatgatgtcgatcatatcgtcccacaatcattcttgaaagatgattcaatcgat aacaaagtcttgacaagatcagataaaaacagaggaaaatcagataacgtcccat cagaagaagtcgtcaaaaaaatgaaaaactattggagacaattgttgaacgcaaaa ttgatcacacaaagaaaattcgataacttgacaaaagcagaaagaggaggattgtc agaattggataaagcaggattcatcaaaagacaattggtcgaaacaagacaaatca caaaacatgtcgcacaaaatcttggattcaagaatgaacacaaaaatatgatgaaac gataaattgatcagagaagtcaaagtcatcacattgaaatcaaaattggtttcagatttt cagaaaagatttccaattctataaagtcagagaaatcaacaactatcatcatgcacat gatgcatatttgaacgcagtcgtcggaacagcattgatcaaaaaaatatccaaattg gaatcagaattcgtctatgagattataaagtctatgatgtcagaaaaatgatcgcaa aatcagaacaagaaatcggaaaagcaacagcaaaatatttcttctattcaaacatca tgaacttcttcaaaacagaaatcacattggcaaacggagaaatcagaaaagacc attgatcgaaacaaacggagaaacaggagaaatcgtctgggtaaaggaagaga tttcgcaacagtcagaaaagtcttgtcaatgccacaagtcaacatcgtcaaaaaaac agaagtccaaacaggaggattctcaaaagaatcaatcttgccaaaaagaaactca gataaattgatcgcaagaaaaaaagattgggatccaaaaaaatatggaggattcga ttcaccaacagtcgcatattcagtcttggtcgtcgcaaaagtcgaaaaaggaaaatc aaaaaaattgaaatcagtcaaagaattgttgggaatcacaatcatggaaagatcatc attcgaaaaaaacccaatcgatttcttggaagcaaaaggatataaagaagtcaaaa aagatttgatcatcaaattgccaaaatattcattgttcgaattggaaaacggaagaaa aagaatgttggcatcagcaggagaattgcaaaaaggaaacgaattggcattgcca tcaaaatatgtcaacttcttgtattttggcatcacattatgaaaaattgaaaggatcacc agaagataacgaacaaaaacaattgttcgtcgaacaacatcaaacattatttggatga |

TABLE 5B-continued

Exemplary Cas sequences

| SEQ ID NO: | Name | Sequence |
|---|---|---|
| | | aatcatcgaacaaatctcagaattctcaaaaagagtcatcttggcagatgcaaactt ggataaagtcttgtcagcatataacaaacatagagataaaccaatcagagaacaag cagaaaacatcatccatttgttcacattgacaaacttgggagcaccagcagcattca aatatttcgatacaacaatcgatagaaaaagatatacatcaacaaaagaagtcttgg atgcaacattgatccatcaatcaatcacaggattgtatgaaacaagaatcgatttgtc acaattgggaggagatc |

In some embodiments, the HDR cassette and the guide RNAs of a gene described herein are cloned into the plasmid. In some embodiments, the HDR cassette and the guide RNAs of a PsiD gene described herein are cloned into the plasmid.

In some embodiments, pCambria1300 with an introduced B-AMA1 sequence is used in an HDR method described herein. In some embodiments, a pCambria1300 comprising an introduced B-AMA1 sequence plasmid can become self-replicating. In some embodiments, different spCas9 variants are used in an HDR method described herein. In some embodiments, a plasmid described herein comprises an spCas9 variant. In some embodiments, an HDR cassette and a PsiD gene guide RNA can be cloned into the plasmid. In some embodiments, B-AMA1 replication origin and a Cas9 variant can be cloned into the plasmid. In some embodiments, an HDR cassette and a PsiD gene guide RNA, the B-AMA1 replication origin and a Cas9 variant can be cloned into the plasmid. In some embodiments, an entry vector is assembled with a final plasmid backbone for protoplast transformation is in a Magic Gate reaction using a Bsal restriction enzyme. In some embodiments, the entry vector is HDRPsiDguideMGRiboF with a sequence comprising: CACCtgggagCTGATGAGTCCGT-GAGGACGAAACGAGTAAGCTCGTCCTCC-CAACACTT GATCATGC (SEQ ID NO: 664). In some embodiments, the entry vector is HDRPsiDguideMGRiboR with a sequence comprising: AAACGCATGAT-CAAGTGTTGGGAGGACGAGCT-TACTCGTTTCGTCCTCACGGACTCA TCAGctccca (SEQ ID NO: 665). In some embodiments, a PsiD guide RNA is introduced into a minor groove binding (MGB) ribozyme backbone. In some embodiments, this results in a plasmid comprising (SEQ ID NO: 666)
GACGCTGTGGATCAAGCAACGCCACTCGCTCGCTCCATCGC

AGGCTGGTCGCAGACAAATTAAAAGGCGGCAAACTCGTAC

AGCCGCGGGGTTGTCCGCTGCAAAGTACAGAGTGATAAAA

GCCGCCATGCGACCATCAACGCGTTGATGCCCAGCTTTTT

CGATCCGAGAATCCACCGTAGAGGCGATAGCAAGTAAAGA

AAAGCTAAACAAAAAAAATTTCTGCCCCTAAGCCATGAA

AACGAGATGGGGTGGAGCAGAACCAAGGAAAGAGTCGCGC

TGGGCTGCCGTTCCGGAAGGTGTTGTAAAGGCTCGACGCC

CAAGGTGGGAGTCTAGGAGAAGAATTTGCATCGGGAGTGG

GGGGGGTTACCCCTCCATATCCAATGACAGATATCTACCA

-continued

GCCAAGGGTTTGAGCCCGCCCGCTTAGTCGTCGTCCTCGC

TTGCCCCTCCATAAAAGGATTTCCCCTCCCCCTCCCACAA

AATTTTCTTTCCCTTCCTCTCCTTGTCCGCTTCAGTACGT

ATATCTTCCCTTCCCTCGCTTCTCTCCTCCATCCTTCTTT

CATCCATCTCCTGCTAACTTCTCTGCTCAGCACCTCTACG

CATTACTAGCCGTAGTATCTGAGCACTTCTCCCTTTTATA

TTCCACAAAACATAACACAACCTTCACCtgggagCTGATG

AGTCCGTGAGGACGAAACGAGTAAGCTCGTCCTCCCAACA

CTTGATCATGCGTTTTAGAGCTAGAAATAGCAAGTTAAAA

TAAGGCTAGTCCGTTATCAACTTGAAAAAGTGGCACCGAG

TCGGTGCTTTTGGCCGGCATGGTCCCAGCCTCCTCGCTGG

CGCCGGCTGGGCAACATGCTTCGGCATGGCGAATGGGACT

GAGAAACAGGTCGGAAGCCAATGGCCAGGAGCTCCTTGTA

AAAAAATACTCCTTGGTCTATTAAGTTGCCCATTCTTTAG

CAGGAGTGTGCAGACTATGTCCGTATCCACATGCCGCAAC

TGCAGATTCATAGGAGCTGTTGGGGATATTGGCATAGGAT

CCCATTGTTACGTACTATTTAATGACAAATACACGATCAA

TTTCACCACTATTGTTCACTTCTACTGGTAGCTTAGACGT

ACTATTTCTCGTGGAATAGCCAGTACTTGCTCTTATATTG

GCCGTCGCGAATTTCGGCGTCGACAACGAGCTACCACATT

TGTTCATGCCAGGCAGCTGAGGACTTGAAAGCCTTGAAAT

GCCGAAGGTAGTATATCCCGCGTTCCTTTATCAGATTAGA

ACAAATGCCGTTCTATCATCTGGGTATACTTAGTCCTTTT

GACCGGGGAAATATGTCACGTGCAAGGCGCTTTGGAAGCT

TCCGACC.

In some embodiments, a repair cassette described herein is cloned. In some embodiments, primers are used to amplify a homologous recombination (HR) of a PsiD gene. In some embodiments the primer is a primer listed in TABLE 6A-6C.

TABLE 6A

Exemplary Primers for left-flanking HR PsiD amplification-PsiD repair cassette cloning

| SEQ ID No. | Name | Sequence |
|---|---|---|
| 679 | HDRF1500 | aacaggtctcaacctGCTAGGTTCTCCAATTTCATTCGT |
| 680 | HDRF1250 | aacaggtctcaacctACTGGATTAGGTTGAAGAACCG |
| 681 | HDRR1 | TTCAATCTACTTGCGGACCTCTGATCAAGTGTTGGGAGCAGA |

TABLE 6B

Exemplary Primers for Right-flanking HR PsiD amplification-PsiD repair cassette cloning

| SEQ ID No. | Name | Sequence |
|---|---|---|
| 682 | HDRF3 | CTCTCGCTTGCATACCACaTGCAGGTGATACCCGC |
| 683 | HDRR3250 | aacaggtctcatgttTGAATTCCTGGATAGGTTGCATG |
| 684 | HDRR3500 | aacaggtctcatgttGCAGAGAAGCCCGCTC |

In some embodiments, a GPD-intron described herein will be amplified using a primer in TABLE 6C with a GPD:intron plasmid described herein.

TABLE 6C

Exemplary Primers for GPD-intron amplification- PsiD repair cassette cloning

| SEQ ID No. | Name | Sequence |
|---|---|---|
| 685 | HDRF2 | TCTGCTCCCAACACTTGATCAGAGGTCCGCAAGTAGATTGAA |
| 686 | HDRR2-long intron | GCGGGTATCACCTGCAtCTACAAGTCGACATCAGTGAGC |

In some embodiments, a combination of primers from TABLES 6A-6C are used. In some embodiments the plasmid comprises a tRNA-gRNA-scaffold sequence. In some embodiments, the gRNA comprises a PsiD gene gRNA. In some embodiments, the tRNA sequence comprises: ACTAGATTCCCTTACGCCTTCCATCACCTGTCCGCACCCGGCCCCATCCCGCTTTCAACCCCCCGCTCCGAGCCGGCACCGGAGCACACCCACCCAAACCGGTTCGATGGCGTA GTTGGTTATCGCATCTGTCTAACACACAGAAGGTCCTCAGTTCGAGCCTGGGTCGAA TCA (SEQ ID NO: 667). In some embodiments the gRNA sequence comprises: CTCCCAACACTTGATCATGC (SEQ ID NO: 661). In some embodiments the scaffold sequence comprises: gtttTAGAGCTAGAAATAGCAAGTTAAAATAAGGCTAGTCCGTTATCAACTTGAAAAAGTGGCACCGAGTCGGTGCTTTTTTatgc-cacaacactggtggtacc (SEQ ID NO: 668). In some embodiments the tRNA sequence is: ACTAGATTCCCTTACGCCTTCCATCACCTGTCCGCACCCGGCCCCATCCGCTTTCAA CCCCCCGCTCCGAGCCGGCACCGGAGCACACCCACCCAAACCGGTTCGATGGCGTA GTTGGTTATCGCATCTGTCTAACACACAGAAGGTCCTCAGTTCGAGCCTGGGTCGAA TCA (SEQ ID NO: 667). In some embodiments the gRNA sequence is: CTCCCAACACTTGATCATGC (SEQ ID NO: 661). In some embodiments the scaffold sequence is: gtttTAGAGCTAGAAATAGCAAGTTAAAATAAGGCTAGTCCGTTATCAACTTGAAAAAGTGGCACCGAGTCGGTGCTTTTTTatgc-cacaacactggtggtacc (SEQ ID NO: 668). In some embodiments, tRNA-gRNA-scaffold sequence comprises: ACTAGATTCCCTTACGCCTTCCATCACCTGTCCGCACCCGGCCCCATCCCGCTTTCAA CCCCCCGCTCCGAGCCGGCACCGGAGCACACCCACCCAAACCGGTTCGATGGCGTA GTTGGTTATCGCATCTGTCTAACACACAGAAGGTCCTCAGTTCGAGCCTGGGTCGAA TCACTCCCAACACTTGATCATGCgtttTAGAGCTAGAAATAGCAAGTTAAAATAAGGCT AGTCCGTTATCAACTTGAAAAAGTGGCACCGAGTCGGTGCTTTTTTatgccacaacactggtgg tacc (SEQ ID NO: 669). In some embodiments, tRNA-gRNA-scaffold sequence is: ACTAGATTCCCTTACGCCTTCCATCACCTGTCCGCACCCGGCCC-CATCCCGCTTTCAA CCCCCCGCTCCGAGCCGGCACCGGAGCACACC-CACCCAAACCGGTTCGATGGCGTA GTTGGTTATCGCATCTGTCTAACACACAGAAGGTCCTCAGTTCGAGCCTGGGTCGAA TCACTCCCAACACTTGATCATGCgtttTAGAGCTAGAAATAGCAAGTTAAAATAAGGCT AGTCCGTTATCAACTTGAAAAAGTGGCACCGAGTCGGTGCTTTTTTatgccacaacactggtgg tacc (SEQ ID NO: 669). In some embodiments, tRNA-gRNA-scaffold is merged together with an HDR repair cassette sequence and a B-AMA1 sequence. In some embodiments the HDR repair cassette sequence comprises: ACTGGATTAGGTTGAAGAACCGGCGATCTGGGCAGACGCGCCACGCTCTGAGTACC TAAGGGTGTACTTAAACTGGATTAGGTTGAAGAACCGGC-GATCTGGGCAGACGCGC CACGCTCTGAGTACCTAAGGGTGTACTTAAATTTAT-CACAGCTTGACGTTTGACCTG GAAGCTTGATTTACGCAAGGTTGGAACTTGCACCCCCCGGTCGAGCATCTCTCTA GTCATAGTTTATCTTTGTATAAATGGGGCCT-CAACGCAAGGCCGCAAAACTACTCC CAACTTTTATAACTCATTTCTGCTCCCAACACTTGATCAGAGGTCCGCAAGTAGATT GAAAGTTCAGTACGTTTTTAACAATAGAGCATTTTCGAGGCTTGCGTCATTCTGTGT CAGGCTAGCAGTTTATAAGCGTTGAGGATCTAGAGCTGCTGTTCCCGCGTCTCGAAT GTTCTCGGTGTTTAGGGGTTAGCAATCTGATATGATAATAATTTGTGATGACATCGA TAGTACAAAAACCCCAATTCCGGTCACATCCAC-CATCTCCGTTTTCTCCCATCTACAC ACAACAAGCTCATCGCCGTTTGTCTCTCGCTTG-CATACCACCCAGCAGCTCACTGAT GTCGACTTGTA-GaTGCAGGTGA-TACCCGCGTGCAACTCGGCGTACGTCGTTTTTATTC GCTGACTTCACCCGCTAATTACTATAACTT-GAAAACACAGAGCAATAAGATCACTAT GTCC-TACTCCCGAGTCTTTGAGAAACATGG-GATGGCTCTCTGTCAGCGATGCGGTCT ACAGCGAGTTCATAGGAGAGTTGGC-
TACCCGCGCTTCCAATCGAAATTACTCCAACG
AGTTCGGCCTCATGCAACCTATCCAGGAATTCA
(SEQ ID NO: 670). In some embodiments the HDR repair cassette sequence is: ACTGGATTAGGTT-
GAAGAACCGGCGATCTGGGCAGACGCGC-
CACGCTCTGAGTACC TAAGGGTGTACTTAAACTG-
GATTAGGTTGAAGAACCGGCGATCTGGGCAGACGC
GC CACGCTCTGAGTACCTAAGGGTGTACTTAAATT-
TATCACAGCTTGACGTTTGACCTG GAAGCTTGATT-
TACGCAAGGTTGGAACTTGCACCCCCCGGTCGAG-
CATCTCTCTA
GTCATAGTTTATCTTTGTATAAATGGGGGCCT-
CAACGCAAGGCCGCAAAACTACTCC CAACTTT-
TATAACTCATTTCTGCTCCCAACACTT-
GATCAGAGGTCCGCAAGTAGATT
GAAAGTTCAGTACGTTTTTAACAATAGAGCAT-
TTTCGAGGCTTGCGTCATTCTGTGT
CAGGCTAGCAGTTTATAAGCGTTGAG-
GATCTAGAGCTGCTGTTCCCGCGTCTCGAAT
GTTCTCGGTGTTTAGGGGTTAGCAATCTGATATGA-
TAATAATTTGTGATGACATCGA TAGTA-
CAAAAACCCCAATTCCGGTCACATCCAC-
CATCTCCGTTTTCTCCCATCTACAC
ACAACAAGCTCATCGCCGTTTGTCTCTCGCTTG-
CATACCACCCAGCAGCTCACTGAT GTCGACTTGTA-
GaTGCAGGTGA-
TACCCGCGTGCAACTCGGCGTACGTCGTTTTTATTC
GCTGACTTCACCCGCTAATTACTATAACTT-
GAAAACACAGAGCAATAAGATCACTAT GTCC-
TACTCCCGAGTCTTTGAGAAACATGG-
GATGGCTCTCTGTCAGCGATGCGGTCT
ACAGCGAGTTCATAGGAGAGTTGGC-
TACCCGCGCTTCCAATCGAAATTACTCCAACG
AGTTCGGCCTCATGCAACCTATCCAGGAATTCA
(SEQ ID NO: 670). In some embodiments, the B-AMA1 sequence comprises: attaccgatcctc-
gatctttgtgcaagctagcccgcctcggcagcaacaaagcagccgagcaagaag
cagtacttgccttctgaatcgtgaa tgggttacgttcttcaccgctgt-
gatcagcgaatcatgaatcaaatcatgagggcattgctgatcatgaatcaaatcat-
gagggcatttaaaaat tcagtctgagtcgtgagtagcaagtcggttctggatcg-
gatggcattcatgaatcacagggtcgtgaatcatgaatgttcaagtcccctttctc
gagaggctggtgggatcggtgcgaatcacgaatcatgattgtaattcattgagt-
gaaggagtttcgcagccacccacagtactagaatcacg aatgacaat (SEQ ID NO: 648). In some embodiments, the B-AMA1 sequence is: attaccgatcctc-
gatctttgtgcaagctagcccgcctcggcagcaacaaagcagccgagcaagaagc
agtacttgccttctgaatcgtgaa tgggttacgttcttcaccgctgtgatcagcgaat-
catgaatcaaatcatgagggcattgctgatcatgaatcaaatcatgagggcatt-
taaaaat tcagtctgagtcgtgagtagcaagtcggttctggatcggatggcattcat-
gaatcacagggtcgtgaatcatgaatgttcaagtcccctttctc
gagaggctggtgggatcggtgcgaatcacgaatcatgattgtaattcattgagt-
gaaggagtttcgcagccacccacagtactagaatcacg aatgacaat (SEQ ID NO: 648). In some embodiments, a B-AMA1 sequence, and HDR repair cassette, and a tRNA-gRNA-scaffold are merged by an overlapping PCR method and inserted into a pMGA entry plasmid. In some embodiments the pMGA plasmid comprises SEQ ID: 309.

Microhomology Mediated End Joint Methods

In some embodiments, a method for double-stranded repair (DSB) is used to gene-edit a fungus. In some embodiments, the method of gene-editing used is microhomology mediated end joint (MMEJ), also referred to as alternative non-homologous end joint (A-NHEJ). MMEJ is similar to Homologous directed repair (HDR) involves end resection and rely on homologous sequence for DSB repair. The length of the homologues sequence used by MMEJ and HDR can be different. With MMEJ the homology flanking region ranges from 2-50 bp while HDR uses between 500 to 5000 bp. MMEJ repair can involve annealing the small sequences and gap filling by DNA polymerase theta near the DSB, resulting in small to large deletions and templated insertions. This approach involves the use of in vitro assembled Crispr Cas9 ribonucleoprotein (RNP) complexes and double stranded DNA template repair (35S promoter: Hygromycin:35S terminator) flanked with 35 bp microhomology sequence upstream and downstream regions of the DSB site that allows for precise homologous recombination after the Cas targeted cut. In some embodiments, the 35 bp microhomology sequence comprises: CTAATGAATATT-
AGCCAGTACGTCGCGTCGAACGA (SEQ ID NO: 671).
In some embodiments, the 35 bp microhomology sequence comprises: TGCTAATTGGCAGTAGCACGATT-
TATCGTGTGCCG (SEQ ID NO: 672). In some embodiments, the 35 bp microhomology sequence is a guide RNA. In some embodiments, the 35 bp microhomology sequence functions as a guide RNA. In some embodiments, the 35 bp microhomology sequence is operably linked to a target locus sequence. In some embodiments, an MMEJ method for gene editing includes the use of a target locus sequence. In some embodiments, the target locus sequence comprises: CTCGGCATATCGGCTATCATGCAATATTAT-
TGGCTGGGCATCGACTCCGGTTTAAAA ACTC-
CATCGGACTTGTATCTTGCAATCCGGCTGT-
CACTGCCTTTTCCTTGCCCATCTT
GAAGTTCGTCGGTTCCCGTTTTCTCCGAACAAGGAT-
TTTGGGTAGTATGACGACAGA TGCATCAT-
TACTTGTGCGAGCAAATCGGATTCCATTACTCATG-
GAGCGGGCGGCGCT
AATGAATATT-
AGCCAGTACGTCGCGTCGAACGAAGGTCAAC-
CATGTCCTATCGACA CTA-
CAGTAATAGCTTCTTGCGCACACTAAGAAGTCTGG
ACACAAGAACCGTTGTATC ATTTG-
GATGGTTCCGCTCCCAGCCCGGTCAGCTGT-
CACAAGTGAGATCAAACCCGAC TTCGTCCGAGG-
GAAATGGCTTTCATATCAGTGAAAAGGTGTCAATAT
AAGTGAACAT TTCACCAATCTGCGGCACACGA-
TAAATCGTGCTACTGCCAATTAGCAGTTGGCGTAG
AGAAGCAATCGAGTAACTGATAGGAAAAGAAGGT-
ATTATAAGGGAAAATTTAGAA CGTGGTTCCCT-
CACTAACCAACCTTTAGACAAGGCTCC-
TATCGTGCCGGGGTTCTTG
TGCCCATTATAAGGTCGAAGGAGGAGAC-
TATAGGCGGCAATGGAACCATCATCTTC ACA-
CATCGAGGGTGTTCTGGAACAATTATGACGTTT-
CAATGAAGGGCATGCGATAC
AAAAATGCAATGGTGACTTCAAGGTCAATAT-
TGCCTTCATTTACAGAAACTGGTAAT CTATCTT-
CAATTGCAGCCAGAGAACTCCCCATCTGA (SEQ ID NO: 673). In some embodiments, the target locus sequence is: CTCGGCATATCGGCTATCATGCAATATTAT-
TGGCTGGGCATCGACTCCGGTTTAAAA ACTC-
CATCGGACTTGTATCTTGCAATCCGGCTGT-
CACTGCCTTTTCCTTGCCCATCTT
GAAGTTCGTCGGTTCCCGTTTTCTCCGAACAAGGAT-
TTTGGGTAGTATGACGACAGA TGCATCAT-
TACTTGTGCGAGCAAATCGGATTCCATTACTCATG-
GAGCGGGCGGCGCT
AATGAATATT-
AGCCAGTACGTCGCGTCGAACGAAGGTCAAC-
CATGTCCTATCGACA CTA-
CAGTAATAGCTTCTTGCGCACACTAAGAAGTCTGG
ACACAAGAACCGTTGTATC ATTTG- GATGGTTCCGCTCCCAGCCCGGTCAGCTGTCACAAGTGAGATCAAACCCGAC TTCGTCCGAGGGAAATGGCTTTCATATCAGTGAAAAGGTGTCAATAT AAGTGAACAT TTCACCAATCTGCGGCACACGATAAATCGTGCTACTGCCAATTAGCAGTTGGCGTAG AGAAGCAATCGAGTAACTGATAGGAAAAGAAGGTATTATAAGGGAAAATTTAGAA CGTGGTTCCCTCACTAACCAACCTTTAGACAAGGCTCCTATCGTGCCGGGGTTCTTG TGCCCATTATAAGGTCGAAGGAGGAGACTATAGGCGGCAATGGAACCATCATCTTC ACACATCGAGGGTGTTCTGGAACAATTATGACGTTTCAATGAAGGGCATGCGATAC AAAAATGCAATGGTGACTTCAAGGTCAATATTGCCTTCATTTACAGAAACTGGTAAT CTATCTTCAATTGCAGCCAGAGAACTCCCCATCTGA (SEQ ID NO: 673). In some embodiments, the target locus comprises a 35 bp homology sequence comprising: CTAATGAATATTAGCCAGTACGTCGCGTCGAACGA (SEQ ID NO: 671). In some embodiments, the target locus comprises a 35 bp homology sequence comprising: TGCTAATTGGCAGTAGCACGATTTATCGTGTGCCG (SEQ ID NO: 672). In some embodiments, an MMEJ method used herein comprises a zero blunt topo vector backbone, an enhanced 35S promoter, a hygromycin gene, and a 35S terminator. In some embodiments, an MMEJ method used herein has a repair template comprising:

(SEQ ID NO: 674)
AGTGTGCTGGAATTCGCCCTTGAGACTTTTCAACAAAGGG

TAATATCGGGAAACCTCCTCGGATTCCATTGCCCAGCTAT

CTGTCACTTCATCAAAAGGACAGTAGAAAAGGAAGGTGGC

ACCTACAAATGCCATCATTGCGATAAAGGAAAGGCTATCG

TTCAAGATGCCTCTGCCGACAGTGGTCCCAAAGATGGACC

CCCACCCACGAGGAGCATCGTGGAAAAAGAAGACGTTCCA

ACCACGTCTTCAAAGCAAGTGGATTGATGTGATAACATGG

TGGAGCACGACACTCTCGTCTACTCCAAGAATATCAAAGA

TACAGTCTCAGAAGACCAAAGGGCTATTGAGACTTTTCAA

CAAAGGGTAATATCGGGAAACCTCCTCGGATTCCATTGCC

CAGCTATCTGTCACTTCATCAAAAGGACAGTAGAAAAGGA

AGGTGGCACCTACAAATGCCATCATTGCGATAAAGGAAAG

GCTATCGTTCAAGATGCCTCTGCCGACAGTGGTCCCAAAG

ATGGACCCCCACCCACGAGGAGCATCGTGGAAAAAGAAGA

CGTTCCAACCACGTCTTCAAAGCAAGTGGATTGATGTGAT

ATCTCCACTGACGTAAGGGATGACGCACAATCCCACTATC

CTTCGCAAGACCTTCCTCTATATAAGGAAGTTCATTTCAT

TTGGAGAGGACACGCTGAAATCACCAGTCTCTCTCTACAA

ATCTATCTCTCGAGCTTTCGCAGATCCCGGGGGCAAT

GAGATATGAAAAGCCTGAACTCACCGCGACGTCTGTCGA

GAAGTTTCTGATCGAAAAGTTCGACAGCGTCTCCGACCTG

ATGCAGCTCTCGGAGGGCGAAGAATCTCGTGCTTTCAGCT

TCGATGTAGGAGGGCGTGGATATGTCCTGCGGGTAAATAG

CTGCGCCGATGGTTTCTACAAAGATCGTTATGTTTATCGG

CACTTTGCATCGGCCGCGCTCCCGATTCCGGAAGTGCTTG

ACATTGGGGAGTTTAGCGAGAGCCTGACCTATTGCATCTC

CCGCCGTGCACAGGGTGTCACGTTGCAAGACCTGCCTGAA

ACCGAACTGCCCGCTGTTCTACAACCGGTCGCGGAGGCTA

TGGATGCGATCGCTGCGGCCGATCTTAGCCAGACGAGCGG

GTTCGGCCCATTCGGACCGCAAGGAATCGGTCAATACACT

ACATGGCGTGATTTCATATGCGCGATTGCTGATCCCCATG

TGTATCACTGGCAAACTGTGATGGACGACACCGTCAGTGC

GTCCGTCGCGCAGGCTCTCGATGAGCTGATGCTTTGGGCC

GAGGACTGCCCCGAAGTCCGGCACCTCGTGCACGCGGATT

TCGGCTCCAACAATGTCCTGACGGACAATGGCCGCATAAC

AGCGGTCATTGACTGGAGCGAGGCGATGTTCGGGGATTCC

CAATACGAGGTCGCCAACATCTTCTTCTGGAGGCCGTGGT

TGGCTTGTATGGAGCAGCAGACGCGCTACTTCGAGCGGAG

GCATCCGGAGCTTGCAGGATCGCCACGACTCCGGGCGTAT

ATGCTCCGCATTGGTCTTGACCAACTCTATCAGAGCTTGG

TTGACGGCAATTTCGATGATGCAGCTTGGGCGCAGGGTCG

ATGCGACGCAATCGTCCGATCCGGAGCCGGGACTGTCGGG

CGTACACAAATCGCCCGCAGAAGCGCGGCCGTCTGGACCG

ATGGCTGTGTAGAAGTACTCGCCGATAGTGGAAACCGACG

CCCCAGCACTCGTCCGAGGGCAAAGAAATAGAGTAGATGC

CGACCGGATCTGTCGATCGACAAGCTCGAGTTTCTCCATA

ATAATGTGTGAGTAGTTCCCAGATAAGGGAATTAGGGTTC

CTATAGGGTTTCGCTCATGTGTTGAGCATATAAGAAACCC

TTAGTATGTATTTGTATTTGTAAAATACTTCTATCAATAA

AATTTCTAATTCCTAAAACCAAAATCCAGTACTAAAATCC

AGATC.

Split-Marker Cassettes Methods

In some embodiments, an exogenous nucleic acid can be integrated into the genome of the genetically modified organism by homologous recombination. Homologous recombination permits site specific modifications in endogenous genes and thus inherited or acquired mutations may be corrected, and/or novel alterations may be engineered into the genome of the genetically modified organism using homologous directed repair (HDR). In some embodiments, a split cassette HDR method is used. In some embodiments, a gene described herein is replaced with a hygromycin resistance gene. In some embodiments, a PsiD, a PsiH, a PsiH2, a PsiK, a PsiP, a PsiP2, a TrpE, a PsiM, a PsiT1, a PsiT2 gene, or a portion thereof, or any combination thereof, is excised and a hygromycin resistance gene is introduced, for example, into a plasmid. In some embodiments, the hygromycin resistance gene is not integrated, or not stably integrated, into the genome of the engineered fungal cell. In some embodiments, a PsiD gene is replaced with a hygromycin resistance gene. In some embodiments, a PsiH gene is replaced with a hygromycin resistance gene. In some embodiments, a PsiH2 gene is replaced with a hygromycin resistance gene. In some embodiments, a PsiK gene is replaced with a hygromycin resistance gene. In some embodiments, a PsiL gene is replaced with a hygromycin resistance gene. In some embodiments, a PsiM gene is replaced with a hygromycin resistance gene. In some embodiments, a PsiP gene is replaced with a hygromycin resistance gene. In some embodiments, a PsiP2 gene is replaced with a hygromycin resistance gene. In some embodiments, a PsiT1 gene is replaced with a hygromycin resistance gene. In some embodiments, a PsiR gene is replaced with a hygromycin resistance gene. In some embodiments, a PsiT2 gene is replaced with a hygromycin resistance gene. In some embodiments the hygromycin resistance gene is 35s hygromycin. In some embodiments, one or more cassettes are comprised in a plasmid described herein. In some embodiments the cassette is a cassette described in TABLE 7B. In some embodiments, the DNA component of a gene described herein is split into two cassettes. In some embodiments, these can be referred to as split marker cassettes. In some embodiments, the split marker cassettes are used in conjunction with in vitro assembled Cas9-guide RNA ribonucleoproteins (TABLE 7A). In some embodiments, the Cas9-guide RNA ribonucleoproteins is a sequence selected from the group consisting of any of SEQ ID NOs: 660-663. In some embodiments the split marker cassettes are used in conjunction with in vitro assembled Cas9-guide RNA ribonucleoproteins for rapid and efficient gene deletions. In some embodiments the cassette is at least 1 kb. In some embodiments the cassette is at least 1 kilobase (kb), at least 1.1 kb, at least 1.2 kb, at least 1.3 kb, at least 1.4 kb, at least 1.5 kb, at least 1.6 kb, at least 1.7 kb, at least 1.8 kb, at least 1.9 kb, or at least 2.0 kb. In some embodiments, multiple guide RNAs are used. In some embodiments a first guide RNA is located at the start of a gene described herein, and a second guide RNA is placed at the end of the same gene described herein for replacement. In some embodiments, the guide RNAs are each independently selected from a guide RNA sequence in TABLE 7A. In some embodiments the split marker cassette has a sequence listed in TABLE 7B. In some embodiments, an upstream homology arm sequence (UHA) can be at least 500 base pairs (bp), at least 550 bp, at least 600 bp, at least 650 bp, at least 700 bp, at least 750 bp, at least 800 bp, at least 850 bp, at least 900 bp, at least 950 bp, or at least 1000 bp. In some embodiments, a downstream homology arm sequence (DHA) can be at least 500 base pairs (bp), at least 550 bp, at least 600 bp, at least 650 bp, at least 700 bp, at least 750 bp, at least 800 bp, at least 850 bp, at least 900 bp, at least 950 bp, or at least 1000 bp.

TABLE 7A

HDR guide RNA sequences

| Sequence No. | Guide at Start (S) or Guide at End (E) | Sequence |
|---|---|---|
| 660 | S | TCACCTGCATGATCAAGTGT |
| 661 | S | CTCCCAACACTTGATCATGC |
| 662 | S | CAGAAATGAGTTATAAAAGT |
| 663 | E | CGAAGTCGTCGCTGCTCTAA |

TABLE 7B

Exemplary Cassettes for HDR integration of PsiD

| SEQ ID NO: | Split Cassette | |
|---|---|---|
| 687 | 1 | TAGTCGTGTGCATTCATACAGTAATGGCGATTTCATC
TAACCGCACACAATAGAAATCGG
AAGCAGGTCGGTTGCAACCAAGTTCCAACTGCCGCTT
TGACTCCACCTCACCTTTCCCCC
AGCCGGACAGCCTGCTTTTCTTCTTAGTTGTTCGGTGC
AACACTGGAACCTGGAAAGATT
GTCGGCAGTTCTCCATCCTGAGTATCTATAATTTCTTT
CTATTCGGGGTGTGTTCGGTTC
GAGCATGGCGCGTATTGGCTAGGTTCTCCAATTTCAT
TCGTCAGGTATGACCTGGGTATG
ACCGACCTGTTTACTTCTCGTAATTGATATTTCAACAA
TTCCTCTTAGATATCCATCTCT
GAGATTGGTAAGGAGTATTTCGCACGACAGGCCTAA
CACTAGATCACCTTTCCTACCTTC
CATGCACGCTTACATCTCATGCTTGCTGTAGTAAAGA
AGAGGTCGTGTGCCACATTGCTA
GAACAAAGCATGCATTACGTCAATACCACTGGATTAG
GTTGAAGAACCGGCGATCTGGGC
AGACGCGCCACGCTCTGAGTACCTAAGGGTGTACTTA
AATTTATCACAGCTTGACGTTTG
ACCTGGAAGCTTGATTTACGCAAGGTTGGAACTTGCA
CCCCCCGGTCGAGCATCTCTCTC
TAGTCATAGTTTATCTTTGTATAAATGGGGGCCTCAA
CGCAAGGCCGCAAAACTACTCCC
AACTTTTATAACTCATTTCTGCTCCCAACACtcagaagacc
aaagggctattgagactttt
tcaacaaagggtaatatcgggaaacctcctcggattccattgcccagctatctgtcactt
catcaaaaggacagtagaaaaggaaggtggcacctacaaatgccatcattgcgataaagg
aaaggctatcgttcaagatgcctctgccgacagtggtcccaaagatggaccccaccac
gaggagcatcgtggaaaagaagacgttccaaccacgtcttcaaagcaagtggattgatg
tgataacatggtggagcacgacactctcgtctactccaagaatatcaaagatacagtctc |

TABLE 7B-continued

Exemplary Cassettes for HDR integration of PsiD

|   |   |   |
|---|---|---|
|   |   | agaagaccaaagggctattgagacttttcaacaaagggtaatatcgggaaacctcctcgg<br>attccattgcccagctatctgtcacttcatcaaaaggacagtagaaaaggaaggtggcac<br>ctacaaatgccatcattgcgataaaggaaaggctatcgttcaagatgcctctgccgacag<br>tggtcccaaagatggaccccccaccacgaggagcatcgtggaaaaagaagacgttccaac<br>cacgtcttcaaagcaagtggattgatgtgatatctccactgacgtaaggatgacgcaca<br>atcccactatccttcgcaagaccttcctctatataaggaagttcatttcatttggagagg<br>acacgctgaaatcaccagtctctctctacaaatctatctctctcgagctttcgcagatcc<br>cgggggcaatgagatatgaaaaagcctgaactcaccgcgacgtctgtcgagaagtttct<br>gatcgaaaagttcgacagcgtctccgacctgatgcagctctcggagggcgaagaatctcg<br>tgctttcagcttcgatgtaggagggcgtggatatgtcctgcgggtaaatagctgcgccga<br>tggtttctacaaagatcgttatgtttatcggcactttgcatcggccgcgctcccgattcc<br>ggaagtgcttgacattggggagtttagcgagagcctgacctattgcatctcccgccgtgc<br>acagggtgtcacgttgcaagacctgcctgaaaccgaactgcccgctgttctacaaccggt<br>cgcggaggctatggatgcgatcgctgcggccgatcttagccagacgagcgggttcggccc<br>attcggaccgcaaggaatcggtcaatacactacatggcgtgatttcatatgcgcgattgc<br>tgatccccatgtgtatcactggcaaactgtgatggacgacaccgtcagtgcgtccgtcgc<br>gcaggctctcgatgagctgatgctttgggccgaggactgccccgaagtccggcacctcgt<br>gcacgcggatttcggctccaacaatgtcctgacggacaatggccgcataacagcggtcat<br>tgactggagcgaggcgatgttcggggattcccaatacgaggtcgccaacatcttcttctg<br>gaggccgtggttggcttgtatggagcagcagacgcgctacttcgagcggaggcatccgga<br>gcttgcaggatcgccacgactccgggcgtatatgctccgcattggtcttgaccaactcta<br>tcagagcttggttgacggcaatttcgatgatgcagctttgggcgcagggtcgatgcgacgc<br>aatcgtccgatccggagccgggactgtcgggcgtacacaaatcgcccgcagaa |
| SEQ ID NO: 688 | Split cassette 2 | tctccactgacgtaagggatgacgcacaatcccactatccttcgcaagaccttcctctat<br>ataaggaagttcatttcatttggagaggacacgctgaaatcaccagtctctctctacaaa<br>tctatctctctcgagctttcgcagatcccgggggcaatgagatatgaaaaagcctgaac<br>tcaccgcgacgtctgtcgagaagtttctgatcgaaaagttcgacagcgtctccgacctga<br>tgcagctctcggagggcgaagaatctcgtgctttcagcttcgatgtaggagggcgtggat<br>atgtcctgcgggtaaatagctgcgccgatggtttctacaaagatcgttatgtttatcggc<br>actttgcatcggccgcgctcccgattccggaagtgcttgacattggggagtttagcgaga<br>gcctgacctattgcatctcccgccgtgcacagggtgtcacgttgcaagacctgcctgaaa<br>ccgaactgcccgctgttctacaaccggtcgcggaggctatggatgcgatcgctgcggccg<br>atcttagccagacgagcgggttcggcccattcggaccgcaaggaatcggtcaatacacta<br>catggcgtgatttcatatgcgcgattgctgatccccatgtgtatcactggcaaactgtga<br>tggacgacaccgtcagtgcgtccgtcgcgcaggctctcgatgagctgatgctttgggccg<br>aggactgccccgaagtccggcacctcgtgcacgcggatttcggctccaacaatgtcctga<br>cggacaatggccgcataacagcggtcattgactggagcgaggcgatgttcggggattccc<br>aatacgaggtcgccaacatcttcttctggaggccgtggttggcttgtatggagcagcaga<br>cgcgctacttcgagcggaggcatccggagcttgcaggatcgccacgactccgggcgtata<br>tgctccgcattggtcttgaccaactctatcagagcttggttgacggcaatttcgatgatg<br>cagctttgggcgcagggtcgatgcgacgcaatcgtccgatccggagccgggactgtcgggc<br>gtacacaaatcgcccgcagaagcgcggccgtctgaccgatggctgtgtagaagtactcg<br>ccgatagtggaaaccgacgcccagcactcgtccgagggcaaagaaatagagtagatgcc<br>gaccggatctgtcgatcgacaagctcgagtttctccataataatgtgtgagtagttccca<br>gataagggaattagggttcctatagggtttcgctcatgtgttgagcatataagaaaccct<br>tagtatgtatttgtatttgtaaaatacttctatcaataaaatttctaattcctaaaacca<br>aaatccagtactaaaatccagatcccccgaattaattcggcgttCTAAAGGCTT<br>AGCTGT<br>ATGCACAATTGTTGGACGTTTGCATTAATGTCCCGAA<br>CGCAAAAAATGCAAGACATTTGC<br>AAGTATTGTAATTAGTAGATGTACGAATATCCAGCAT<br>GTATGTTTGTACCCCAAAATATT<br>ACGGCACCCAAAAATAAATACAGTTTGCTCGGCGCTA<br>GTCAGTGAATGACGCACCTAAAT<br>AGATCATATTGTTGCAACATTACCCATGCCATGCCAC<br>TGCCGTGCCCCTACTCTGACCGA<br>ACTTCGATATCCAACGCACCCTAATAATTAAATATAC<br>CACCGTAAAAAAGAAGGGAGAAA<br>AGTCTTCCAAGTTGCTACGTCCCCACTGTTTGGGGGT<br>TTCCAGAGCCCAAAAATCTCAAT<br>CGGCCCCAGAGTGGACACTGGACACGAACCAGGAAT<br>CCTACTCGGTACTGAAGAAGGGAT<br>TATCTATTGTTAGGGCGTACTGAGGCCCCAAAAATGA<br>GTAGCTCTATTCGGTGAAGCAAG<br>ATATATTAACTATTATTAGAGCACGTTGGCAACTTGA<br>CATCATTACAGGTTCATCTTCAA<br>GGTATGCATTATGCCTGTTTGGGTATCGCGTCTTGAG<br>GGACTCTCAAAGTCTTGACCAAG<br>CGATCCAAACTGAAGCGACGCCGGACGCGAATGTAA<br>TGCAAAGACTTTCTTCCTTTGACC<br>CAATTGGGCTTTTCCCTTTGTGTCAATCGGATACTTT<br>AAAGTCAATTATCTCGTCATGC<br>CACTGCTCTTATCTAACATT |
| SEQ ID NO: 689 | psiD region<br>scaffold 7<br>scaffold 7 | TCCTTCTTCATCTAACACTCTTATTTATACCTGAAGTT<br>AACCCCTGTTTTCTTCGACAG<br>GATTGGCGATATCTCGCGATCCATGGCCCAACTCAGA |

TABLE 7B-continued

Exemplary Cassettes for HDR integration of PsiD

```
ATATTTGCAGCTAAATACCCACC
GGAAGGCATCAAAACCCCACCACCCAAACTTTCATG
GCAGTCCACACGTACAGCACTCGT
TGGGAAGCGTCCTTTAGTGCGCATGACTCCGGTAGTT
GAAGTACCAGATGATACCGTCCC
GCCTCTTCTCACTTTCCGCAATATTGATGTTCTACATC
AACGACTTATCTATGAGGACAG
AGTATCTGATATAGCATATCTCACTTGGTTATGCAAG
TCATACGAATGGGGTTTGCGCAT
TCGGCGCGACAAGGCACATAAATCCAAAGCTGCCGA
TGCCTAGTGTTGACGCCTGCCTAC
ACGTTTGCCTTTGCAGCACCGTCTTGTATAATTTTCTA
TTTTAAATTATTAATGCATCTA
ACACGATTTGTAGGGTACTTTATCTTATCTTTTAAATC
AATTAAATTTGCTCATTGTTGG
CCGTAGATATAGGAGATTTATGGAGGTTTTCATCTTG
CTTTCACAGTCTCACCATAATAG
TCGTGTGCATTCATACAGTAATGGCGATTTCATCTAA
CCGCACACAATAGAAATCGGAAG
CAGGTCGGTTGCAACCAAGTTCCAACTGCCGCTTTGA
CTCCACCTCACCTTTCCCCCAGC
CGGACAGCCTGCTTTTCTTCTTAGTTGTTCGGTGCAAC
ACTGGAACCTGGAAAGATTGTC
GGCAGTTCTCCATCCTGAGTATCTATAATTTCTTTCTA
TTCGGGGTGTGTTCGGTTCGAG
CATGGCGCGTATTGGCTAGGTTCTCCAATTTCATTCGT
CAGGTATGACCTGGGTATGACC
GACCTGTTTACTTCTCGTAATTGATATTTCAACAATTC
CTCTTAGATATCCATCTCTGAG
ATTGGTAAGGAGTATTTCGCACGACAGGCCTAACACT
AGATCACCTTTCCTACCTTCCAT
GCACGCTTACATCTCATGCTTGCTGTAGTAAAGAAGA
GGTCGTGTGCCACATTGCTAGAA
CAAAGCATGCATTACGTCAATACCACTGGATTAGGTT
GAAGAACCGGCGATCTGGGCAGA
CGCGCCACGCTCTGAGTACCTAAGGGTGTACTTAAAT
TTATCACAGCTTGACGTTTGACC
TGGAAGCTTGATTTACGCAAGGTTGGAACTTGCACCC
CCCGGTCGAGCATCTCTCTCTAG
TCATAGTTTATCTTTGTATAAATGGGGCCTCAACGC
AAGGCCGCAAAACTACTCCCAAC
TTTTATAACTCATTTCTGCTCCCAACACTTGATCATGC
AGGTGATACCCGCGTGCAACTC
GGCGTACGTCGTTTTTATTCGCTGACTTCACCCGCTAA
TTACTATAACTTGAAAACACAG
AGCAATAAGATCACTATGTCCTACTCCCGAGTCTTTG
AGAAACATGGGATGGCTCTCTGT
CAGCGATGCGGTCTACAGCGAGTTCATAGGAGAGTT
GGCTACCCGCGCTTCCAATCGAAA
TTACTCCAACGAGTTCGGCCTCATGCAACCTATCCAG
GAATTCAAGGCTTTCATTGAAAG
CGACCCGGTGGTGCACCAAGAATTTATTGACATGTTC
GAGGGCATTCAGGACTCTGTTAG
TCTTTACTTTATGTATATTGTATTTTCTTACTTATCATG
TGTAGCCAAGGAATTATCAGG
AACTATGTAATATGTTCAACGATATCTTTCGCAAAGC
TCCCGTCTACGGAGACCTTGGCC
CTCCCGTTTATATGATTATGGCCAAATTAATGAACAC
CCGAGCGGGCTTCTCTGCATTCA
CGAGACAAAGGTTGAACCTTCACTTCAAAAAACTTTT
CGATACCTGGGGATTGTTCCTGT
CTTCGAAAGATTCTCGAAATGTTCTTGTGGCCGACCA
GTTCGACGACAGACATTGCGGCT
GGTTGAACGAGCGGGCCTTGTCTGCTATGGTTAAACA
TTACAATGGACGCGCATTTGATG
AAGTCTTCCTCTGCGATAAAAATGCCCCATACTACGG
CTTCAACTCTTACGACGACTTCT
TTAATCGCAGATTTCGAAACCGAGATATCGACCGACC
TGTCGTCGGTGGAGTTAACAACA
CCACCCTCATTTCTGCTGCTTGCGAATCACTTTCCTAC
AACGTCTCTTATGACGTCCAGT
CTCTCGACACTTTAGTTTTCAAAGGAGAGACTTATTC
GCTTAAGCATTTGCTGAATAATG
ACCCTTTCACCCCACAATTCGAGCATGGGAGTATTCT
ACAAGGATTCTTGAACGTCACCG
CTTACCACCGATGGCACGCACCCGTCAATGGGACAAT
CGTCAAAATCATCAACGTTCCAG
GTACCTACTTTGCGCAAGCCCCGAGCACGATTGGCGA
```

TABLE 7B-continued

Exemplary Cassettes for HDR integration of PsiD

```
CCCTATCCCGGATAACGATTACG
ACCCACCTCCTTACCTTAAGTCTCTTGTCTACTTCTCT
AATATTGCCGCAAGGCAAATTA
TGTTTATTGAAGCCGACAACAAGGAAATTGGCCTCAT
TTTCCTTGTGTTCATCGGCATGA
CCGAAATCTCGACATGTGAAGCCACGGTGTCCGAAG
GTCAACACGTCAATCGTGGCGATG
ACTTGGGAATGTTCCATTTCGGTGGTTCTTCGTTCGCG
CTTGGTCTGAGGAAGGATTGCA
GGGCAGAGATCGTTGAAAAGTTCACCGAACCCGGAA
CAGTGATCAGAATCAACGAAGTCG
TCGCTGCTCTAAAGGCTTAGCTGTATGCACAATTGTT
GGACGTTTGCATTAATGTCCCGA
ACGCAAAAAATGCAAGACATTTGCAAGTATTGTAATT
AGTAGATGTACGAATATCCAGCA
TGTATGTTTGTACCCCAAAATATTACGGCACCCAAAA
ATAAATACAGTTTGCTCGGCGCT
AGTCAGTGAATGACGCACCTAAATAGATCATATTGTT
GCAACATTACCCATGCATGCCA
CTGCCGTGCCCCTACTCTGACCGAACTTCGATATCCA
ACGCACCCTAATAATTAAATATA
CCACCGTAAAAAGAAGGGAGAAAAGTCTTCCAAGT
TGCTACGTCCCCACTGTTTGGGGG
TTTCCAGAGCCCAAAAATCTCAATCGGCCCCAGAGTG
GACACTGGACACGAACCAGGAAT
CCTACTCGGTACTGAAGAAGGGATTATCTATTGTTAG
GGCGTACTGAGGCCCCAAAAATG
AGTAGCTCTATTCGGTGAAGCAAGATATATTAACTAT
TATTAGAGCACGTTGGCAACTTG
ACATCATTACAGGTTCATCTTCAAGGTATGCATTATG
CCTGTTTGGGTATCGCGTCTTGA
GGGACTCTCAAAGTCTTGACCAAGCGATCCAAACTGA
AGCGACGCCGGACGCGAATGTAA
TGCAAAGACTTTCTTCCTTTGACCCAATTGGGCTTTTC
CCTTTGTGTCTAATCGGATACT
TTAAAGTCAATTATCTCGTCATGCCACTGCTCTTATCT
AACATTAGTCCTTCACCTTCAA
TTCAATGACGGCCTTTCCTTTGAGAAGATCAAATATA
CGGTGAATACATACCTTCAGCAG
CGTGGCGATTCATAATAAGTGTACTCAAAGGGTCCTT
CTATTTAACAGGTATTATTATGA
CGGCGAATATGAAAACGTAAAACAATGTAACCCCCT
GCATGAGATGATATCATATCACGC
ATGATCCTCATGCCTGAAAAGATTGTGTACACGTTGT
GAACAGATTAGATTGTACCCGCG
ATGGTCGACTTCTATACTAACTGATAGATACATAAGG
CTAGTGTCCTGAAGGTCAAGACC
AGTAGCTCTCCCCTCATCCTGTCATCCAAAATACACC
GCTATGCATATCAGAAATCCTTA
CCGTACACCAATTGACTATCAAGCACTTTCAGAGGCC
TTCCCTCCCCTCAAGCCATTGTG
CGTTTGCCGTCTACTTCCTATTTAAAAATGCTGATCCT
CCATGATAGTGTGTCTGTCAAT
GCAGATGGTACCAGTTCTGTTGACCTCACTATCCCAG
AAGCCCAGAGGTCAGCACTGTAT
ATCTATTCAAATGCTTAGGCTGATTTAAGCTAGGGCG
TTCACGGCTGCTCTTCTTCATCG
TGACTTCGGGCTCACCATGACCATACCAGAAGACCGT
CTGTGCCCAACAGTACGTCAAAG
ATGCCT
```

In some embodiments, HDR methods include using sequence to replace a promoter of a gene described herein with a GPDi promoter. In some embodiments, the GPDi promoter has a sequence comprising: GAGGTCCGCAAGTAGATTGAAAGTTCAGTACGTTTTAACAATAGAGCATTTTCGAG GCTTGCGTCATTCTGTGTCAGGCTAGCAGTTTATAAGCGTTGAGGATCTAGAGCTGC TGTTCCCGCGTCTCGAATGTTCTCGGTGTTTAGGGGT
TAGCAATCTGATATGATAATAATTTGTGATGACATCGATAGTACAAAAACCC CAATTCCGGTCACATCCACCATCTCCGTTTTCTCCCATCTACACACAACAAGCTCATC GCCGTTTGTCTCTCGCTTGCATACCACCCAGCAGCTCACTGATG TCGACTTGTAG (SEQ ID NO: 675). In some embodiments a repair template is used with homology arms on either side of the GPDi promoter. In some embodiments, the homology arms are 111 base pairs to the left of the GPDi promoter. In some embodiments, the homology arms are 125 base pairs to the right of the GPDi promoter. In some embodiments, the homology arms are 111 base pairs to the left of the GPDi promoter and the homology arms are 125 base pairs to the right of the GPDi promoter. In embodiments describing directionality, interpretation should be 5' to 3' directionality unless otherwise indicated. In some embodiments, the first (left) HDR guide is: CTCCCAACACTT-GATCATGC (SEQ ID NO: 661). In some embodiments, the second (right) HDR guide is: TCACCTGCATGAT-CAAGTGT (SEQ ID NO: 660). In some embodiments the repair template sequence for HDR methods performed on a genetically modified organism is:

(SEQ ID NO: 676)
CGAGCATCTCTCTCTAGTCATAGTTTATCTTTGTATAAAT

GGGGGCCTCAACGCAAGGCCGCAAAACTACTCCCAACTTT

TATAACTCATTTCTGCTCCCAACACTTGATCGAGGTCCGC

AAGTAGATTGAAAGTTCAGTACGTTTTTAACAATAGAGCA

TTTTCGAGGCTTGCGTCATTCTGTGTCAGGCTAGCAGTTT

ATAAGCGTTGAGGATCTAGAGCTGCTGTTCCCGCGTCTCG

AATGTTCTCGGTGTTTAGGGGTTAGCAATCTGATATGATA

ATAATTTGTGATGACATCGATAGTACAAAAACCCCAATTC

CGGTCACATCCACCATCTCCGTTTTCTCCCATCTACACAC

AACAAGCTCATCGCCGTTTGTCTCTCGCTTGCATACCACC

CAGCAGCTCACTGATGTCGACTTGTAGATGCAGGTGATAC

CCGCGTGCAACTCGGCGTACGTCGTTTTTATTCGCTGACT

TCACCCGCTAATTACTATAACTTGAAAACACAGAGCAATA

AGATCACTATGTCCTACTCCCGAGTCTTTGAG.

This disclosure provides methods for genetically modifying an organism for increased production of one or more alkaloids. In some embodiments, a genetic modification is accomplished by introducing an exogenous nucleic acid, e.g., a donor sequence, into a cell of the organism. Exemplary cells of the organisms include a fungal cell. Exemplary fungal cells include a protoplast. The exogenous nucleic acid may encode one or more gene products that, when expressed by the genetically modified organism, result in the genetically modified organism producing an increased amount of the one or more alkaloids as compared to a comparable wild-type organism. In some instances, the one or more genes can be one of the genes listed in TABLE 1 or TABLE 2. In some instances, one or more copies of the one or more genes included in TABLE 1 or TABLE 2 are provided by the exogenous nucleic acid. For example, in some instances at least 1, 2, 3, 4, 5, 6, or 7 copies of the one or more genes are introduced into the genetically modified organism with the exogenous nucleic acid. In some cases, at least a portion of the exogenous nucleic acid can be integrated into the genome of the organism. For example, the exogenous nucleic acid can be inserted into a genomic break. In some instances, at least a portion of the exogenous nucleic acid includes sequences that are homologous to sequences flanking a target sequence for targeted integration. Methods of introducing an exogenous nucleic acid into a cell of an organism are generally known to the skilled artisan but may include the use of homology arms. In other instances, the exogenous nucleic acid can be randomly inserted into a genome of a target organism.

In some embodiments, an exogenous nucleic acid can be integrated to the genome of the genetically modified organism by virtue of homologous recombination. Homologous recombination permits site specific modifications in endogenous genes and thus inherited or acquired mutations may be corrected, and/or novel alterations may be engineered into the genome of the genetically modified organism.

In some embodiments, the exogenous nucleic acid includes a promoter sequence. Increasing expression of designed gene products may be achieved by synthetically increasing expression by modulating promoter regions or inserting stronger promoters upstream of desired gene sequences. In some embodiments, for example, a gene promoter such as 35S gene promoter is used.

In some embodiments, the exogenous nucleic acid can include a barcode or watermark sequence, which may be referred to as "a barcode". A barcode can comprise a non-natural sequence. In some embodiments, the barcode can be used to identify transgenic organisms via genotyping. In some embodiments, the exogenous nucleic acid can include a selectable marker, such as an antibiotic resistance gene. Selectable marker genes can include, for example, a hygromycin resistance gene.

In some embodiments, a unique sequence is embedded into the genome of a genetically modified organism described herein using gene editing methods such as CRISPR for identification purposes. In some embodiments, this is referred to as a marker or marker sequence. In some embodiments this is referred to as a watermark sequence. In some embodiments, this is referred to as an intergenic sequence, or a portion thereof. In some embodiments, this is referred to as an intergenic watermark sequence. In some embodiments, this is referred to as barcoding as noted above. In some embodiments, the sequence encoding the marker can be incorporated into the genetically modified cell or organism, for instance a fungal cell, yeast cell or plant cell as described herein. In some cases, a marker serves as a selection or screening device may function in a regenerable genetically modified organism to produce a compound that would confer upon a tissue in said organism resistance to an otherwise toxic compound. In some embodiments, the incorporated sequence encoding the marker may by subsequently removed from the transformed genome. Removal of a sequence encoding a marker may be facilitated by the presence of direct repeats before and after the region encoding the marker. In some embodiments, the marker sequence is followed by a protospacer adjacent motif (PAM), in order to provide appropriate cleavage by a Cas nuclease.

In some embodiments, the exogenous nucleic acid can be introduced into the genetically modified organism by transformation or transfection.

Transformation appropriate transformation techniques can include but are not limited to: electroporation of fungi protoplasts; liposome-mediated transformation; polyethylene glycol (PEG) mediated transformation; transformation using viruses; micro-injection of cells; microprojectile bombardment of cells; vacuum infiltration; and *Agrobacterium tumefaciens* mediated transformation. Transformation can mean introducing a nucleotide sequence into a cell in a manner to cause stable or transient expression of the sequence.

Following transformation, fungi or other organisms can be selected using a dominant selectable marker incorporated into, for example, the transformation vector. In certain embodiments, such marker confers antibiotic or herbicide resistance on the transformed fungi or other organisms, and selection of transformants can be accomplished by exposing the fungi and other organisms to appropriate concentrations of the antibiotic or herbicide. In some embodiments, a ccdb negative selection marker is used. In some embodiments the ccdb negative selection marker is prepared by transforming a ccdb sensitive *E. coli* strain, e.g., DH5a. After transformed fungi or other organisms are selected and grown to maturity, those fungi and other organisms showing a modified trait are identified. The modified trait can be any of those traits described above. Additionally, expression levels or activity of the polypeptide or polynucleotide described herein can be determined by analyzing mRNA expression, using Northern blots, RT-PCR, RNA seq or microarrays, or protein expression using immunoblots or Western blots or gel shift assays.

Suitable methods for transformation of fungal or other cells for use with the current disclosure can include virtually any method by which a nucleic acid can be introduced into a cell, such as by direct delivery of DNA such as by PEG-mediated transformation of protoplasts, by desiccation/inhibition-mediated DNA uptake, by electroporation, by agitation with silicon carbide fibers, by *Agrobacterium*-mediated transformation and by acceleration of DNA coated particles. Through the application of techniques such as these, the cells of virtually any fungus species may be stably transformed, and these cells developed into transgenic fungi. Methods of introducing an exogenous nucleic acid into a cell of an organism may include the use of homology arms. In other instances, the exogenous nucleic acid can be randomly inserted into a genome of a target organism.

*Agrobacterium*-Mediated Transformation

*Agrobacterium*-mediated transfer can be used to introduce an exogenous nucleic acid into an organism selected for genetic modification, such as a fungal cell. In some instances, the exogenous nucleic acid can be introduced into whole fungal tissues, thereby by passing the need for regeneration of an intact fungus from a protoplast. The use of *agrobacterium*-mediated transformation can be used to integrate one or more vectors into the genetically modified organisms, including vectors or sequences encoding gene-editing systems, such as CRISPR systems or donor sequences.

This disclosure includes advances in vectors for *agrobacterium*-mediated gene transfer by providing improved the arrangement of genes and restriction on sites in the vectors to facilitate the construction of vectors capable of expressing various polypeptide coding genes. In some embodiments, a vector can have convenient multi-linker regions flanked by a promoter and a polyadenylation site for direct expression of inserted polypeptide coding genes and are suitable for purposes described herein. In addition, *Agrobacterium* containing both armed and disarmed Ti genes can be used for the transformations.

In some embodiments, a fungal cell, yeast cell, plant cell, may be modified using electroporation. To effect transformation by electroporation, one may employ either friable tissues, such as a suspension culture of cells or embryogenic callus or alternatively one may transform immature embryos or other organized tissue directly. In some cases, electroporation may comprise 2 pulses, 3 pulses, 4 pulses, 5 pulses 6 pulses, 7 pulses, 8 pulses, 9 pulses, or 10 or more pulses. In some embodiments, protoplasts of fungi and/or plants may be used for electroporation transformation.

Another method for delivering or transforming DNA segments to fungal cells and cells derived from other organisms in accordance with the invention is microprojectile bombardment. In this method, particles may be coated with nucleic acids and delivered into cells by a propelling force. Exemplary particles include those comprised of tungsten, platinum, and preferably, gold. It is contemplated that in some instances DNA precipitation onto metal particles would not be necessary for DNA delivery to a recipient cell using microprojectile bombardment. However, it is contemplated that particles may contain DNA rather than be coated with DNA. In some embodiments, DNA-coated particles may increase the level of DNA delivery via particle bombardment. For the bombardment, cells in suspension are concentrated on filters or solid culture medium. Alternatively, immature embryos or other target cells may be arranged on solid culture medium. The cells that can be bombarded are positioned at an appropriate distance below the macroprojectile stopping plate. In some cases, a starting cell density for genomic editing may be varied to optimize editing efficiency and/or cell viability.

In some embodiments, fungi, yeast or plants of the present disclosure can be used to produce new plant varieties. In some embodiments, the plants are used to develop new, unique and superior varieties or hybrids with desired phenotypes. In some embodiments, selection methods, e.g., molecular marker assisted selection, can be combined with breeding methods to accelerate the process. In some embodiments, a method comprises (i) crossing any organism provided herein comprising the expression cassette as a donor to a recipient organism line to create a FI population, (ii) selecting offspring that have expression cassette. Optionally, the offspring can be further selected by testing the expression of the gene of interest. In some embodiments, complete chromosomes of a donor organism are transferred. For example, the transgenic organism with an expression cassette can serve as a male or female parent in a cross pollination to produce offspring by receiving a transgene from a donor thereby generating offspring having an expression cassette. In a method for producing organisms having the expression cassette, protoplast fusion can also be used for the transfer of the transgene from a donor to a recipient. Protoplast fusion is an induced or spontaneous union, such as a somatic hybridization, between two or more protoplasts (cells in which the cell walls are removed by enzymatic treatment) to produce a single bi- or multi-nucleate cell. In some embodiments, mass selection can be utilized. In mass selection, desirable individual plants are chosen, harvested, and the seed composited without progeny testing to produce the following generation. Since selection is based on the maternal parent only, and there is no control over pollination, mass selection amounts to a form of random mating with selection. As stated herein, the purpose of mass selection is to increase the proportion of superior genotypes m the population.

In some embodiments, an organism is genetically modified using a gene editing system. The gene editing system can be selected form the group consisting of a CRISPR system, TALEN, Zinc Finger, transposon-based, ZEN, meganuclease, Mega-TAL, and any combination thereof. In some embodiments, the gene editing system is directed to a target of interest by a guide polynucleotide. In some embodiments, the gene editing system involves an endonuclease or a nuclease or a polypeptide encoding a nuclease can be from a CRISPR system. An endonuclease or a nuclease or a polypeptide encoding a nuclease can be a Cas or a polypeptide encoding a Cas. CRISPR can refer to a family of DNA repeats found in certain bacterial genomes. In some instances, the CRISPR protein can include a Cas9 endonuclease, which can form a complex with a crRNA/tracrRNA hybrid to recognize, bind, and ultimately cleave foreign DNA at a target site. The crRNA/tracrRNA hybrid can be designed as a single guide RNA (gRNA). For example, any one or more of the guide RNAs shown in TABLE 7A, TABLE 8 through TABLE 16. In some embodiments, the gRNA sequence is followed by a protospacer adjacent motif (PAM), in order to provide appropriate cleavage by a Cas nuclease.

The recognition of a target DNA target region can depend on a protospacer adjacent motif (PAM) which can be located at the 3'-terminus of a 20 bp target sequence. Once the CRISPR complex (e.g., Cas9 and associated guide RNA) recognizes the target DNA sequence, the CRISPR complex can generate a double strand break (DSB) at the DNA target locus. In some instances, one of two cellular DNA repair mechanisms, non-homologous end joining (NHEJ) and homologous recombination (HR), can play a role in precise genome editing and gene manipulation. For example, NHEJ, which is sometimes regarded as an error-prone repair mechanism that generates either short insertions or deletions of nucleotides in close proximity to the DSB site(s), can be used. If these short insertions or deletions exist in a gene coding region, or within a portion of the promoter involved in recruiting proteins involved in transcription, the function of the endogenous gene, for example a gene encoding psilocybin phosphatase, can be disrupted. Consequently, this procedure can be used for generating gene mutations. In other embodiments, a homology independent targeted integration (HITI) strategy can be used which allows fragments (e.g., exogenous nucleic acids) to be integrated into the genome by NHEJ repair.

This disclosure provides methods of genetically modifying organism for the production of one or more alkaloids. The genetic modification can be accomplished using a genome editing (also called gene editing) system refers to a group of technologies that give the ability to change an organism's DNA. Compositions and methods described herein take advantage of genome editing systems to make targeted edits in an organism's genome and thereby produce one or more alkaloids that are of interest. To that end, the genome editing systems as used herein can possess programmable nucleases. In some embodiments, the genome editing system comprises a zinc-finger nuclease (ZFN). A zinc finger nuclease is an artificial endonuclease that can comprise a designed zinc finger protein (ZFP) fused to a cleavage domain, such as, a FokI restriction enzyme. In some embodiments, the genome editing system comprises a transcription activator-like effector nuclease (TALEN). TALENs are restriction enzymes that can be engineered to cut specific sequences of DNA. They are made by fusing a TAL effector DNA-binding domain to a DNA cleavage domain (a nuclease which cuts DNA strands). Transcription activator-like effectors (TALEs) can be engineered to bind to practically any desired DNA sequence, so when combined with a nuclease, DNA can be cut at specific locations. In some embodiments, the genome editing system is a meganuclease. In some embodiments, a gene editing system is used in incorporate an exogenous nucleic acid into a fungal, wherein incorporation of the exogenous nucleic acid results in a genetic modification that modulates production of an alkaloid. In some embodiments, the exogenous nucleic acid comprises a sequence that is at least 50%, 55%, 60%, 65%, 70%, 75%, 80%, 85%, 90%, 95%, 99%, or is 100% identical to one of the sequences listed in TABLE 2. In some embodiments, the gene editing system is a CRISPR system, such as the CRISPR-Cas9 endoclease system.

Various versions of CRISPR systems can be used. In some instances, the CRISPR system can be introduced into the genome of a target organism using *Agrobacterium tumefaciens*-mediated transformation. When the expression of Cas protein and guide RNA can be under the control of either a constitutive or inducible promoter. For example, in some embodiments, the Cas protein is under the control of a GDP gene protomer, while the guide RNA is under the control of a U6 gene promoter. In some embodiments, the guide RNA is inserted directly downstream of a *P. cubensis* U6 promoter and directly upstream of the guide RNA scaffold sequence. In some instances, the Cas protein is optimized for use in a fungal cell.

In some cases, an endonuclease or a nuclease or a polypeptide encoding a nuclease can be selected from the group consisting of Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, CARF, DinG, homologues thereof or modified versions thereof. In some cases, a Cas protein can be a Cas9. In some cases, Cas9 is a modified Cas9 that binds to a canonical PAM. In some cases, Cas9 recognizes a non-canonical PAM. In some cases, a guide polynucleotide binds a target sequence 3-10 nucleotides from a PAM. In some cases, a CRISPR enzyme coupled with a guide polynucleotide can be delivered into a genetically modified organism as an RNP. In some cases, a CRISPR enzyme coupled with a guide polynucleotide can be delivered into a genetically modified organism by a mRNA encoding the CRISPR enzyme and the guide polynucleotide. In some cases, the Cas protein is referred to as a Cas endonuclease, or endonuclease In some cases, an endonuclease or a nuclease or a polypeptide encoding a nuclease can be Cas9 or a polypeptide encoding Cas9. In some cases, an endonuclease or a nuclease or a polypeptide encoding a nuclease can be catalytically dead. In some cases, an endonuclease or a nuclease or a polypeptide encoding a nuclease can be a catalytically dead Cas9 or a polypeptide encoding a catalytically dead Cas9. The Cas endonuclease can be optimized for expression in a fungal cell. In some embodiments, the Cas endonuclease is codon optimized. Codon optimization is a process used to improve gene expression and increase the translational efficiency of a gene of interest by accommodating codon bias of organism to be modified. In some embodiments, the Cas endonuclease comprises a sequence that is at least 75 percent, 80 percent, 85 percent, 90 percent, 95 percent, 99 percent, or 100 percent identical to SEQ ID NO: 203. In some embodiments, the Cas endonuclease comprises a nuclear localization signal. The nuclear localization signal can comprise a sequence that is at least 75 percent, 80 percent, 85 percent, 90 percent, 95 percent, 99 percent, or 100 percent identical to ccaaaaaaaaaaagaaaagtcggaatccatggagtcccagcagca (SEQ ID NO: 201). In some embodiments, the Cas endonuclease comprises a FLAG tag. The FLAG tag comprises an artificial antigen to which specific, high affinity monoclonal antibodies have been developed and hence can be used for protein purification by affinity chromatography and also can be used for locating proteins within living cells. The FLAG tag may be attached by a codon optimized linker that is least 75 percent, 80 percent, 85 percent, 90 percent, 95 percent, 99 percent, or 100 percent identical to sequence:

```
                                      (SEQ ID NO: 200)
      gattataaagatcatgatggagattataaagatcatga tatcgattataaagatgatgatgataaagcagca.
```

In some embodiments, the Cas9 endonuclease is codon optimized and has a sequence as follows:

(SEQ ID NO: 203)

```
gataaaaaatattcaatcggattggatatcggaacaaact
cagtcggatgggcagtcatcacagatgaatataaagtccc
atcaaaaaaattcaaagtcttgggaaacacagatagacat
tcaatcaaaaaaacttgatcggagcattgttgttcgatt
caggagaaacagcagaagcaacaagattgaaaagaacagc
aagaagaagatatacaagaagaaaaaacagaatctgctat
ttgcaagaaatcttctcaaacgaaatggcaaaagtcgatg
attcattcttccatagattggaagaatcattcttggtcga
agaagataaaaaacatgaaagacatccaatcttcggaaac
atcgtcgatgaagtcgcatatcatgaaaaatatccaacaa
tctatcatttgagaaaaaaattggtcgattcaacagataa
agcagatttgagattgatctatttggcattggcacatatg
atcaaattcagaggacatttcttgatcgaaggagatttga
acccagataactcagatgtcgataaattgttcatccaatt
ggtccaaacatataaccaattgttcgaagaaaacccaatc
aacgcatcaggagtcgatgcaaaagcaatcttgtcagcaa
gattgtcaaaatcaagaagattggaaaacttgatcgcaca
attgccaggagaaaaaaaaacggattgttcggaaacttg
atcgcattgtcattgggattgacaccaaacttcaaatcaa
acttcgatttggcagaagatgcaaaattgcaattgtcaaa
agatacatatgatgatgatttggataacttgttggcacaa
atcggagatcaatatgcagatttgttcttggcagcaaaaa
acttgtcagatgcaatcttgttgtcagatatcttgagagt
caacacagaaatcacaaaagcaccattgtcagcatcaatg
atcaaagatatgatgaacatcatcaagatttgacattgt
tgaaagcattggtcagacaacaattgccagaaaaatataa
agaaatcttcttcgatcaatcaaaaaacggatatgcagga
tatatcgatggaggagcatcacaagaagaattctataaat
tcatcaaaccaatcttggaaaaaatggatggaacagaaga
attgttggtcaaattgaacagagaagatttgttgagaaaa
caaagaacattcgataacggatcaatcccacatcaaatcc
atttgggagaattgcatgcaatcttgagaagacaagaaga
tttctatccattcttgaaagataacagagaaaaaatcgaa
aaaatcttgacattcagaatcccatattatgtcggaccat
tggcaagaggaaactcaagattcgcatggatgacaagaaa
atcagaagaaacaatcacaccatggaacttcgaagaagtc
gtcgataaaggagcatcagcacaatcattcatcgaaagaa
tgacaaacttcgataaaaacttgccaaacgaaaaagtctt
gccaaaacattcattgttgtatgaatatttcacagtctat
aacgaattgacaaaagtcaaatatgtcacagaaggaatga
```

-continued
```
gaaaaccagcattcttgtcaggagaacaaaaaaaagcaat
cgtcgatttgttgttcaaaacaaacagaaagtcacagtc
aaacaattgaaagaagattattcaaaaaaatcgaatgct
tcgattcagtcgaaatctcaggagtcgaagatagattcaa
cgcatcattgggaacatatcatgatttgttgaaaatcatc
aaagataaagatttcttggataacgaagaaaacgaagata
tcttggaagatatcgtcttgacattgacattgttcgaaga
tagagaaatgatcgaagaaagattgaaaacatatgcacat
ttgttcgatgataaagtcatgaaacaattgaaaagaagaa
gatatacaggatggggaagattgtcaagaaaattgatcaa
cggaatcagagataaacaatcaggaaaaacaatcttggat
ttcttgaaatcagatggattcgcaaacagaaacttcatgc
aattgatccatgatgattcattgacattcaaagaagatat
ccaaaaagcacaagtctcaggacaaggagattcattgcat
gaacatatcgcaaacttggcaggatcaccagcaatcaaaa
aaggaatcttgcaaacagtcaaagtcgtcgatgaattggt
caaagtcatgggaagacataaaccagaaaacatcgtcatc
gaaatggcaagagaaaaccaaacaacacaaaaggacaaa
aaaactcaagagaaagaatgaaaagaatcgaagaaggaat
caaagaattgggatcacaaatcttgaaagaacatccagtc
gaaaacacacaattgcaaaacgaaaaattgtatttgtatt
atttgcaaaacggaagagatatgtatgtcgatcaagaatt
ggatatcaacagattgtcagattatgatgtcgatcatatc
gtcccacaatcattcttgaaagatgattcaatcgataaca
aagtcttgacaagatcagataaaaacagaggaaaatcaga
taacgtcccatcagaagaagtcgtcaaaaaaatgaaaaac
tattggagacaattgttgaacgcaaaattgatcacacaaa
gaaaattcgataacttgacaaaagcagaaagaggaggatt
gtcagaattggataaagcaggattcatcaaaagacaattg
gtcgaaacaagacaaatcacaaaacatgtcgcacaaatct
tggattcaagaatgaacacaaaatatgatgaaaacgataa
attgatcagagaagtcaaagtcatcacattgaaatcaaaa
ttggtttcagatttcagaaaagatttccaattctataaag
tcagagaaatcaacaactatcatcatgcacatgatgcata
tttgaacgcagtcgtcggaacagcattgatcaaaaaatat
ccaaaattggaatcagaattcgtctatggagattataaag
tctatgatgtcagaaaaatgatcgcaaaatcagaacaaga
aatcggaaaagcaacagcaaaatatttcttctattcaaac
atcatgaacttcttcaaaacagaaatcacattggcaaacg
gagaaatcagaaaaagaccattgatcgaaacaaacggaga
aacaggagaaatcgtctgggataaaggaagagatttcgca
```

-continued

```
acagtcagaaaagtcttgtcaatgccacaagtcaacatcg tcaaaaaaacagaagtccaaacaggaggattctcaaaaga atcaatcttgccaaaaagaaactcagataaattgatcgca agaaaaaaagattgggatccaaaaaaatatgggaggattcg attcaccaacagtcgcatattcagtcttggtcgtcgcaaa agtcgaaaaaggaaaatcaaaaaaattgaaatcagtcaaa gaattgttgggaatcacaatcatggaaagatcatcattcg aaaaaaacccaatcgatttcttggaagcaaaaggatataa agaagtcaaaaaagatttgatcatcaaattgccaaaatat tcattgttcgaattggaaaacggaagaaaaagaatgttgg catcagcaggagaattgcaaaaaggaaacgaattggcatt gccatcaaaatatgtcaacttcttgtatttggcatcacat tatgaaaaattgaaaggatcaccagaagataacgaacaaa aacaattgttcgtcgaacaacataaacattatttggatga aatcatcgaacaaatctcagaattctcaaaaagagtcatc ttggcagatgcaaacttggataaagtcttgtcagcatata acaaacatagagataaaccaatcagagaacaagcagaaaa catcatccatttgttcacattgacaaacttgggagcacca gcagcattcaaatatttcgatacaacaatcgatagaaaaa gatatacatcaacaaaagaagtcttggatgcaacattgat ccatcaatcaatcacaggattgtatgaaacaagaatcgat ttgtcacaattggggaggagat.
```

In some cases, a CRISPR enzyme coupled with a guide polynucleotide can be delivered into a genetically modified organism by a vector comprising a nucleic acid encoding the CRISPR enzyme and the guide polynucleotide. In an aspect, a vector can be a binary vector or a Ti plasmid. In an aspect, a vector further comprises a selection marker or a reporter gene. In some cases, a RNP, complex, or vector can be delivered via electroporation, microinjection, mechanical cell deformation, lipid nanoparticles, AAV, lentivirus, *agrobacterium* mediated transformation, biolistic particle bombardment, or protoplast transformation. In some cases, a RNP, mRNA, or vector further comprises a donor polynucleotide or a nucleic acid encoding the donor polynucleotide. In an aspect, a donor polynucleotide comprises homology to sequences flanking a target sequence. In an aspect, a donor polynucleotide further comprises a barcode, a reporter gene, or a selection marker.

In some embodiments, the Cas endonuclease is employed as a base editor. In some embodiments, the Cas nuclease is part of a Cas system. In some embodiments, the cas endonuclease is a part of a fusion protein. In some embodiments, the fusion protein introduces nucleobase editing into a sequence described herein. In some embodiments, the base edit results in a specific alteration in the sequence encoding a protein of interest. In some embodiments, the base edit results in one or more specific alterations in the sequence encoding a protein of interest. In some embodiments, the Cas system comprises an adenine base editor. In some embodiments, the Cas system comprises a cytosine base editor. In some embodiments, the Cas system comprises a cytosine-to-guanine base editor. In some embodiments, base editing results in one point mutation to a sequence described, herein. In some embodiments, base editing results in more than one point mutation to a sequence described, herein, and the endonuclease is coupled to a reverse-transcriptase enzyme. In some embodiments, a prime editing Cas system further comprises a prime-editing guide RNA (pegRNA). PegRNA targets editing machinery at a specific site on a genome, and additionally contains a template sequence and a primer-binding sequence. The template sequence encodes the intended genome-sequence change.

In some embodiments, the method of introducing a genetic modification includes prime editing methods. In prime editing, an endonuclease makes a single-stranded cut in the target sequence.

In some embodiments, base editing or prime editing result in the alteration of genomic sequences. In some embodiments, base editing or prime editing result in the alteration of genomic sequences that control gene expression. In some embodiments, base editing or prime editing result in the increased gene expression of a gene of interest. In some embodiments, base editing or prime editing result in the decreased gene expression of a gene of interest.

In some embodiments, the gene editing system further comprises an exogenous nucleic acid. In some embodiments, the exogenous nucleic acid comprises a psilocybin synthase gene. In some embodiments, exogenous nucleic acid comprises any one of a tryptophan decarboxylase gene, a psilocybin hydroxylase gene, a psilocybin-related methyltransferase gene, a psilocybin-related kinase gene, a psilocybin-related phosphotransferase gene, or a gene encoding a helix-loop-helix transcription factor that binds to an E-box motif. In some embodiments, the exogenous nucleic acid comprises a sequence that has at least a 75 percent, 80 percent, 85 percent, 90 percent, 95 percent, 99 percent, or 100 percent identity to one of SEQ ID NOS: 1-19, 67-70, or 90-98. In some embodiments, the gene editing system is used to integrate the exogenous nucleic acid into a psilocybin synthase gene. In some embodiments, the gene editing system is used to add or delete one or more nucleic acids of a psilocybin synthase gene, e.g., one of the genes listed in TABLE 2, thereby creating a frameshift mutation that results in the downregulation of the gene. In some embodiments, expression of the gene is reduced by about 50 percent, 75 percent, 80 percent, 85 percent, 90 percent, 95 percent, 99 percent, or 100 percent. The down regulation of the gene can be measured by methods known in the art, including, quantitative PCR or RNA sequencing.

In some embodiments, the gene editing system is used in combination with an exogenous nucleic acid to increase expression of a polynucleotide, for example, a polynucleotide comprising a sequence that has at least 75 percent, 80 percent, 85 percent, 90 percent, 95 percent, 99 percent, or 100 percent identity to one of those listed in any one of TABLE 2. In some embodiments, the gene editing system is used in combination with an exogenous nucleic acid to increase expression of a polynucleotide, for example, a polynucleotide comprising a sequence that has at least 75 percent, 80 percent, 85 percent, 90 percent, 95 percent, 99 percent, or 100 percent identity to one of SEQ ID NOs: 1-16, 67-70, 90-96. In some embodiments, the endonuclease is a Cas endonuclease as described in TABLE 5A or TABLE 5B. In some embodiments, the Cas endonuclease is a Cas9 endonuclease. In some embodiments, the Cas9 endonuclease comprises a sequence that is at least 75 percent, at least 80 percent, at least 85 percent, at least 90 percent, at least 95 percent, at least 99 percent, or 100 percent identical to SEQ ID NO: 202. In some embodiments, the endonuclease comprises a nuclear localization signal. For example, in some embodiments, the endonuclease comprises a nuclear localization signal comprising a sequence that is at least 75 percent, 80 percent, 85 percent, 90 percent, 95 percent, 99 percent, or 100 percent identity to SEQ ID NO: 201.

In some embodiments, the Cas endonuclease is employed as a base editor. In some embodiments, the Cas nuclease is part of a Cas system. In some embodiments, the cas endonuclease is a part of a fusion protein. In some embodiments, the fusion protein introduces nucleobase editing into a sequence described herein. In some embodiments, the base edit results in a specific alteration in the sequence encoding a protein of interest. In some embodiments, the base edit results in one or more specific alterations in the sequence encoding a protein of interest. In some embodiments, the Cas system comprises an adenine base editor. In some embodiments, the Cas system comprises a cytosine base editor. In some embodiments, the Cas system comprises a cytosine-to-guanine base editor. In some embodiments, base editing results in one point mutation to a sequence described, herein. In some embodiments, base editing results in more than one point mutation to a sequence described, herein, and the endonuclease is coupled to a reverse-transcriptase enzyme. In some embodiments, a prime editing Cas system further comprises a prime-editing guide RNA (pegRNA). pegRNA targets editing machinery at a specific site on a genome, and additionally contains a template sequence and a primer-binding sequence. The template sequence encodes the intended genome-sequence change.

In some embodiments, the method of introducing a genetic modification includes prime editing methods. In prime editing, an endonuclease makes a single-stranded cut in the target sequence.

In some embodiments, base editing or prime editing result in the alteration of genomic sequences. In some embodiments, base editing or prime editing result in the alteration of genomic sequences that control gene expression. In some embodiments, base editing or prime editing result in the increased gene expression of a gene of interest. In some embodiments, base editing or prime editing result in the decreased gene expression of a gene of interest.

In some embodiments, the Cas endonuclease is encoded by a polynucleotide that is optimized for expression in a fungal cell from the *Psilocybe* genus. Codon optimization is a process used to improve gene expression and increase the translational efficiency of a gene of interest by accommodating codon bias of the fungal cell. In some embodiments, the polynucleotide comprises codons that frequently occur in the *Psilocybe* genus. In some embodiments, the endonuclease comprises a nuclear localization signal. In some embodiments, the Cas endonuclease is encoded by a polynucleotide that is at least 75 percent, 80 percent, 85 percent, 90 percent, 95 percent, 99 percent, or 100 percent identity to SEQ ID NO: 203.

In some embodiments, the expression of the gene editing system inside the fungal cell results in a genetic modification that leads to an increased expression of the psychotropic alkaloid as compared to a comparable fungal cell without the gene editing system. In some embodiments, the psychotropic alkaloid one of N-acetyl-hydroxytryptamine, 4-hydroxy-L-tryptophan, 5-hydroxy-L-tryptophan, 7-hydroxy-L-tryptophan, 4-phosphoryloxy-N,N-dimethyltryptamine, serotonin or a derivative thereof, aeruginascin, 2-(4-Hydroxy-1H-indol-3-yl)-N,N,N-trimethylethan-1-aminium, 4-phosphoryloxy-N,N-dimethyltryptamine, ketamine, melatonin or a derivative thereof, normelatonin, 3,4-Methylenedioxymethamphetamine, isatin, harmine, β-carboline, N,N-dimethyltryptamine (DMT) or a derivative thereof.

In some embodiments, an organism can be genetically modified using an endonuclease. The endonuclease can be used to introduces a genetic modification into a genome of, for example, a fungal cell resulting in an increased amount of one or more desired alkaloids, and/or derivatives or analogs thereof, as compared to an amount of the same compound in a comparable control without a genetic modification. In some embodiments, the endonuclease can be a Cas endonuclease, e.g., a Cas 9 endonuclease. The endonuclease can be guided by a nucleic acid, such as, a guide RNA. The guide RNA can be any one of the guide RNAs disclosed in TABLE 8, TABLE 9, TABLE 10, TABLE 11, TABLE 12, TABLE 13, TABLE 14, TABLE 15, or TABLE 16. The guide RNA can be complementary sequence to any one of the guide RNAs disclosed in TABLE 8, TABLE 9, TABLE 10, TABLE 11, TABLE 12, TABLE 13, TABLE 14, TABLE 15, or TABLE 16. The guide RNA can comprise a sequence that binds to a sequence disclosed in TABLE 8, TABLE 9, TABLE 10, TABLE 11, TABLE 12, TABLE 13, TABLE 14, TABLE 15, or TABLE 16. The guide RNA can comprise a sequence that binds to a sequence disclosed in TABLE 8, TABLE 9, TABLE 10, TABLE 11, TABLE 12, TABLE 13, TABLE 14, TABLE 15, or TABLE 16, under stringent conditions. The guide RNA can comprise a target sequence as disclosed in TABLE 8, TABLE 9, TABLE 10, TABLE 11, TABLE 12, TABLE 13, TABLE 14, TABLE 15, or TABLE 16. The target sequence can be at least 75%, 80%, 85%, 90%, 95%, 99%, or 100% identical to one of sequences disclosed in TABLE 8, TABLE 9, TABLE 10, TABLE 11, TABLE 12, TABLE 13, TABLE 14, TABLE 15, or TABLE 16.

In some embodiments, an endonuclease is delivered with a guide polynucleotide to target the endonuclease to an endogenous nucleic acid of the organism. In some embodiments, the guide polynucleotide binds to the endogenous nucleic acid and ultimately cleaves the endogenous nucleic acid at the target site. Cleavage of the endogenous nucleic acid at the target site can result in a deleterious deletion of a protein encoded by the nucleic acid. In some embodiments, a guide polynucleotide is used to target a gene, e.g., a psilocybin synthase gene for knockdown or knockout. The gene can be a psilocybin synthase gene. The gene can be one of the genes listed in TABLES 1 and 2. The gene can be targeted by designing a guide polynucleotide that is complementary to a portion of one of the genes listed in TABLES 1 and 2. The gene can be targeted by designing a guide polynucleotide that is complementary to a portion of one of the genes listed in TABLES 8-16. The guide polynucleotide can target, for example, a gene comprising a sequence of one of SEQ ID NOS: 29-87. In some embodiments. In some embodiments, the guide polynucleotide binds to a gene comprising a target sequence SEQ ID NOS: 29-87. In some embodiments, the guide polynucleotide binds within about 100 bases, about 75 bases, about 50 bases, about 25 bases, about 5 bases, or 1 base of the sequence comprising one of SEQ ID NOS: 29-87. In some embodiments, the guide polynucleotide binds to the gene at a loci at least partially overlapping the sequence comprising one of SEQ ID NOS: 29-87. In some embodiments, the guide polynucleotide comprises a targeting sequence that is complementary to one of SEQ ID NOS: 29-87. In some embodiments, the guide polynucleotide comprises a targeting sequence that binds to one of SEQ ID NOS: 29-87.

Accordingly, in some embodiments guide polynucleotide is combined with an endonuclease to knockdown or knock out a gene, such as, PsiD, PsiK, PsiM, PsiP1, PsiP2, PsiH, PsiH2, PsiR, TrpD, TrpE, or any combination thereof. PsiP as used herein, unless stated otherwise, refers to a PsiP phosphatase family gene or its protein expression product. When a fungus includes multiple PsiP genes, the genes or their protein expression products referenced herein may be numbered to differentiate, e.g., PsiP1 and PsiP2.

In some embodiments, the gRNA sequence is followed by a protospacer adjacent motif (PAM), in order to provide appropriate cleavage by a Cas nuclease.

The recognition of a target DNA target region can depend on a protospacer adjacent motif (PAM) which can be located at the 3'-terminus of a 20 bp target sequence. Once the CRISPR complex (e.g., Cas9 and associated guide RNA) recognizes the target DNA sequence, the CRISPR complex can generate a double strand break (DSB) at the DNA target locus. In some instances, one of two cellular DNA repair mechanisms, non-homologous end joining (NHEJ) and homologous recombination (HR), can play a role in precise genome editing and gene manipulation. For example, NHEJ, which is sometimes regarded as an error-prone repair mechanism that generates either short insertions or deletions of nucleotides in close proximity to the DSB site(s), can be used. If these short insertions or deletions exist in a gene coding region, or within a portion of the promoter involved in recruiting proteins involved in transcription, the function of the endogenous gene, for example a gene encoding psilocybin phosphatase, can be disrupted. Consequently, this procedure can be used for generating gene mutations. In other embodiments, a homology independent targeted integration (HITI) strategy can be used which allows fragments (e.g., exogenous nucleic acids) to be integrated into the genome by NHEJ repair.

Various versions of CRISPR systems can be used. In some instances, the CRISPR system can be introduced into the genome of a target organism using *Agrobacterium tumefaciens*-mediated transformation. When the expression of Cas protein and guide RNA can be under the control of either a constitutive or inducible promoter. For example, in some embodiments, the Cas protein is under the control of a GDP gene protomer, while the guide RNA is under the control of a U6 gene promoter. In some embodiments, the guide RNA is inserted directly downstream of a *P. cubensis* U6 promoter and directly upstream of the guide RNA scaffold sequence. In some instances, the Cas protein is optimized for use in a fungal cell.

In some embodiments, an endonuclease system that is used to genetically modified an organism described herein comprises a CRISPR enzyme and a guide nucleic that hybridizes with a target sequence in, or adjacent to the gene or the promoter or enhancer associated therewith. In some cases, a target sequence can be at least 18 nucleotides, at least 19 nucleotides, at least 20 nucleotides, at least 21 nucleotides, or at least 22 nucleotides in length.

In some embodiments, a target sequence can be at most 7 nucleotides in length. In some cases, a target sequence can hybridize with at least one of SEQ ID NOS: 1-19 or 90-91, a gene or a regulatory element of a gene selected from TABLE 1. In some cases, a guide nucleic acid can be chemically modified. In an embodiment, a guide polynucleotide is a single guide RNA (sgRNA). In an embodiment, a guide nucleic acid can be a chimeric single guide comprising RNA and DNA. In some cases, a CRISPR enzyme can comprise or be a Cas protein or variant or derivative thereof. In some cases, a Cas protein comprises Cast, Cas1B, Cas2, Cas3, Cas4, Cas5, Cas5d, CasSt, Cas5h, Cas5a, Cas6, Cas7, Cas8, Cas9, Cas10, Csy1, Csy2, Csy3, Csy4, Cse1, Cse2, Cse3, Cse4, CseSe, Csci, Csc2, Csa5, Csn1, Csn2, Csm1, Csm2, Csm3, Csrn4, Csm5, Csm6, Cmr, Cmr3, Cmr4, Cmr5, Cmr6, Csb1, Csb2, Csb3, Csx17, Csx14, CsxlO, Csx16, CsaX, Csx3, Csxl, CsxlS, Csf1, Csf2, CsO, Csf4, Csdl, Csd2, Cstl, Cst2, Cshl, Csh2, Csal, Csa2, Csa3, Csa4, Csa5, C2c1, C2c2, C2c3, Cpf1, CARF, DinG, homologues thereof, or modified versions thereof. In some cases, a Cas protein can be a Cas9. In some cases, Cas9 is a modified Cas9 that binds to a canonical PAM. In some cases, Cas9 recognizes a non-canonical PAM. In some cases, a guide polynucleotide binds a target sequence 3-10 nucleotides from a PAM. In some cases, a CRISPR enzyme coupled with a guide polynucleotide can be delivered into a genetically modified organism as an RNP. In some cases, a CRISPR enzyme coupled with a guide polynucleotide can be delivered into a genetically modified organism by a mRNA encoding the CRISPR enzyme and the guide polynucleotide.

TABLE 8

Exemplary gRNA targets + PAM sequences for PsiD

| SEQ ID NO. | Guide | Sequence + PAM |
|---|---|---|
| 29 | 638/fw | ATTGCGGCTGGTTGAACGAG CGG |
| 30 | 515/fw | TCTCTGCATTCACGAGACAA AGG |
| 31 | 711/rev | AGAGTTGAAGCCGTAGTATG GGG |
| 32 | 275/fw | TTTCATTGAAAGCGACCCGG TGG |
| 33 | 622/fw | CAGTTCGACGACAGACATTG CGG |
| 34 | 793/fw | ATCGACCGACCTGTCGTCGG TGG |

TABLE 9

Exemplary gRNA targets + PAM sequences for PsiP

| SEQ ID NO. | Guide | Sequence + PAM |
|---|---|---|
| 35 | 1043/fw | CTTATCACGATTGAACACGG GGG |
| 36 | 490/rev | GGGGACCACTGTCAGCAGTG GGG |
| 37 | 830/rev | GACTCGCGATTTACCTTCGG AGG |
| 38 | 472/rev | TGGGGTAACGCGCACCATGG CGG |
| 39 | 1066/rev | GTTAGTGCAAGACTCGTAAG GGG |
| 40 | 1105/rev | GCTTTGAATGTCACCGAACG CGG |

TABLE 10

Exemplary gRNA targets + PAM sequences for PsiP2

| SEQ ID NO. | Guide | Sequence + PAM |
|---|---|---|
| 41 | 486/rev | TTGGATATCTGGCTCCATGA CGG |
| 42 | 454/fw | CATCTCCGGTTATACCGCAA GGG |
| 43 | 124/rev | GCTGTTATAGTAGCGTTGGG AGG |
| 44 | 914/fw | CGTGGTAACTGTAGCTCGAA TGG |
| 45 | 335/fw | CTTCCCTCTAATCAATCCTG GGG |
| 46 | 454/fw | CATCTCCGGTTATACCGCAA GGG |

TABLE 11 shows gRNA target sequences for TrpE

| SEQ ID NO. | Guide | Sequence + PAM |
|---|---|---|
| 47 | 1077/fw | TTGCTGGTACCATCAAACGA GGG |
| 48 | 487/rev | GTCGTACGACACATATCCGA TGG |
| 49 | 571/fw | AGATGTTCTTGGGATTCCAG AGG |
| 50 | 821/fw | GTCGGAAAAGATGGCTACGA AGG |
| 51 | 925/rev | GATTTGACGAAGATGACGGT AGG |
| 52 | 803/fw | AATGAGGGGTGTCCAACGT CGG |

TABLE 12

Exemplary gRNA targets + PAM sequences for TrpM

| SEQ ID NO. | Guide | Sequence + PAM |
|---|---|---|
| 53 | 1432/rev | CAAGGAATATGCGTCCACAT CGG |
| 54 | 852/rev | AAAAATACAACATGAAGGGG CGG |
| 55 | 910/rev | CAGCGATAAAAGAAAAGACA CGG |
| 56 | 707/rev | ATTGGTAATCCACCGATGGG AGG |
| 57 | 790/rev | CTCTGACATGGAGGTCAAGG AGG |
| 58 | 580/rev | GGATCTTGAAATGTCTCCAA GGG |

TABLE 13

Exemplary gRNA targets + PAM sequences for PsiH

| SEQ ID NO. | Guide | Sequence + PAM |
|---|---|---|
| 690 | 70/Fw | TCGTTTCTCGTAGAGTGAGG CGG |
| 691 | 91/Rev | AAGGGAATAGGAATGCCAGG CGG |
| 692 | 255/Fw | AGACACCGATATTCTCTACG TGG |
| 693 | 195/Rev | TCATATATTAGAAGTCAACG CGG |

TABLE 14 gRNA + PAM target sequences for PsiR.

| SEQ ID NO. | Guide | Sequence + PAM |
|---|---|---|
| 61 | PsiR (129/fw) | ATTGCTGGAATGCAGCTCAG CGG |
| 62 | PsiR (98/rev) | CATTCCAGCAATGTCTCCTG AGG |
| 63 | PsiR (189/fw) | TTGCCTGGCATGTTCTCGGG CGG |
| 64 | PsiR (903/rev) | ATTGTCACCATCCTTTCCGG AGG |
| 65 | PsiR (645/fw) | CCAAGGCCAAGGCAACAAAG AGG |
| 66 | PsiR (778/fw) | GGCCCGTCCACACATCCCCG CGG |

In some embodiments, are watermark sequences. In some embodiments, watermark sequences are referred to as intergenic sequences. In some embodiments, the watermark sequences are guide RNA sequences. In some embodiments, a plasmid described herein comprises a watermark sequence. In some embodiments the watermark sequence is introduced using guide RNA targets. In some embodiments the watermark sequence is introduced using guide RNA targets with a PAM. In some embodiments, the guide RNA target is a sequence in TABLE 15. In some embodiments, the guide RNA target is 80%, 85%, 90%, 95% or 10000 identical to a sequence in TABLE 15.

TABLE 15

Exemplary gRNA targets + PAM sequences for introducing intergenic watermarks

| SEQ ID NO. | Guide | Sequence + PAM |
|---|---|---|
| 59 | 662/fw | GTGAACATTTCACCAATCTG CGG |
| 60 | 853/fw | TCGAAGGAGGAGACTATAGG CGG |
| 738 | 526/rev | GAACCATCCAAATGATACAA CGG |
| 739 | 301/rev | GAACCGACGAACTTCAAGAT GGG |
| 740 | 456/fw | CAGTACGTCGCGTCGAACGA AGG |
| 741 | 769/rev | GTCTAAAGGTTGGTTAGTGA GGG |

TABLE 16 gRNA target sequences for gene editing of Psi genes

| SEQ ID NO. | Guide | Sequence |
|---|---|---|
| 73 | PsiD (nCas) | CGGTCTACAGCGAGTTCAT |
| 74 | PsiD (nCas) | TTGCATGAGGCCGAACTCGT |
| 75 | PsiD (cas9) | TGGCTCTCTGTCAGCGATG |
| 76 | PsiD (cas9) | CAAATTAATGAACACCCGAG |
| 77 | PsiH (cas9) | GGTTAACATTTCTACAATG |
| 78 | PsiH (cas9) | GGCGAATATGTTGTGCCCAG |
| 79 | PsiK (cas9) | ACGTTCGGTTTACGAATACC |
| 80 | PsiK (cas9) | GCTATATCCGTCGCAAGTGG |
| 81 | PsiM (nCas) | TGGGGACTGTTGGGCACAGA |
| 82 | PsiM (nCas) | TGTGCCCAACAGTCCCCAAT |
| 83 | PsiM (cas9) | GAAGTCACGATGAAGAAGAG |
| 84 | PsiH (ncas9) | TCGTTTCTCGTAGAGTGAGG |

TABLE 16-continued gRNA target sequences for gene editing of Psi genes

| SEQ ID NO. | Guide | Sequence |
|---|---|---|
| 85 | PsiH (ncas9) | GGAATGCCAGGCGGCCCTGG |
| 86 | PsiK (ncas9) | GCCTCCCAGAACCTCCCGAT |
| 87 | PsiK (ncas9) | GCCAATCGGGAGGTTCTGGG |

In some embodiments, the endonuclease comprises at least one nuclear localization signal. In some embodiments, the endonuclease is delivered into a cell as a functional protein, e.g., a ribonucleoprotein, wherein the protein comprises a nuclear localization size and associated with a guide RNA. In other instances, an exogenous nucleic acid encoding at least one RNA-guided endonuclease comprising at least one nuclear localization signal is introduced into the cell of the organism for genetic modification.

In some embodiments, a CRISPR enzyme coupled with a guide polynucleotide can be delivered into a genetically modified organism by a vector comprising a nucleic acid encoding the CRISPR enzyme and the guide polynucleotide. In an embodiment, a vector further comprises a selection marker or a reporter gene. In other cases, a RNP, complex, or vector can be delivered via *agrobacterium* mediated transformation, biolistic particle bombardment, or protoplast transformation. In some cases, a RNP, mRNA, or vector further comprises a donor polynucleotide or a nucleic acid encoding the donor polynucleotide. In an embodiment, a donor polynucleotide (e.g., an exogenous nucleic acid) comprises homology to sequences flanking a target sequence. In one embodiment, a donor polynucleotide further comprises a barcode, a reporter gene, or a selection marker.

In some embodiments, the exogenous nucleic acid is incorporated in a plasmid. In some cases, the plasmid is pGWB5 or pGHGWY. In some cases, the plasmid is delivered into said genetically modified organism via electroporation, microinjection, mechanical ceil deformation, lipid nanoparticles, AAV, lentivirus, *agrobacterium* mediated transformation, biolistic particle bombardment, or protoplast transformation. In some cases, the plasmid further comprises a barcode, a reporter gene, or a selection marker. In some cases, the plasmid further comprises a promoter. In some cases, the promoter is 35S, GPD, EFla, Actin or CcDED1. In some cases, the promoter can be 75%, 80%, 85%, 90%, or 95% identical to SEQ ID NO.: 165. In some cases, the promoter can be 100% identical to SEQ ID NO.: 165. In some cases, the promoter can be 75%, 80%, 85%, 90%, or 95% identical to SEQ ID NO.: 250. In some cases, the promoter can be 100% identical to SEQ ID NO.: 250. In some cases, the promoter can be 75%, 80%, 85%, 90%, or 95% identical to SEQ ID NO.: 251. In some cases, the promoter can be 100% identical to SEQ ID NO.: 251. In some cases, the promoter can be 75%, 80%, 85%, 90%, or 95% identical to SEQ ID NO.: 252. In some cases, the promoter can be 100% identical to SEQ ID NO.: 252. In some cases, the promoter can be 75%, 80%, 85%, 90%, or 95% identical to SEQ ID NO.: 253. In some cases, the promoter can be 100% identical to SEQ ID NO.: 253. In some cases, the promoter can be 75%, 80%, 85%, 90%, or 95% identical to SEQ ID NO.: 30. In some cases, the promoter can be 100% identical to SEQ ID NO.: 30. In some cases, the promoter can be 75%, 80%, 85%, 90%, or 95% identical to SEQ ID NO.: 32. In some cases, the promoter can be 100% identical to SEQ ID NO.: 32.

In some embodiments, a genetic modification can be conducted by contacting a cell of an organism with a gene editing system. In some embodiments, the gene editing system comprises a Cas endonuclease enzyme, a TALE-nuclease, transposon-based nuclease, a zinc finger nuclease, mega nuclease, argonaut, Mega-TAL or DNA guided nuclease. In some embodiments, the gene-editing system comprises a DNA-guided nuclease with an argonaut.

Analysis of Alkaloids Produced in Genetically Modified Organisms

In some embodiments, the alkaloids are quantified by liquid chromatography-mass spectrometry (LC-MS). In some embodiments, samples for quantification are first freeze dried and then quantified by dry weight analysis. In some embodiments, the free-dried samples are quantified for alkaloids by LC-MS. In some embodiments, the alkaloids are quantified by HRMS. In some embodiments, the alkaloids are detected by high resolution mass spectrometry (HRMS). In some embodiments, the alkaloids are further extracted from the fungal tissue samples and then analyzed. In some embodiments, the alkaloids are analyzed by $^1$H NMR (nuclear magnetic resonance), $^{13}$C, or $^{31}$P NMR. In some embodiments, the alkaloids are analyzed by $^1$H NMR, $^{13}$C, and $^{31}$P NMR. In some embodiments, the alkaloids are purified prior to analysis. In some embodiments the alkaloids are isolated and purified. In some embodiments the alkaloids are isolated and purified by a chromatographic method. In some embodiments the alkaloids are isolated and purified using high performance liquid chromatography (HPLC). In some embodiments the alkaloids are isolated and purified using UPLC or UHPLC. In some embodiments, the alkaloids are not isolated or purified and are analyzed in the fungal sample, directly. In some embodiments an extract of the alkaloid or alkaloids isolated from a genetically modified fungus are prepared. In some embodiments, the alkaloids may be purified and isolated, separately. In some embodiments, the alkaloidal content is measured as aggregate alkaloidal content meaning the amount includes the net alkaloidal content of multiple alkaloid compounds produced by a genetically modified fungal cell.

In some embodiments, the alkaloid produced results from a genetic modification to a gene within the psilocybin biosynthetic pathway. In some embodiments, the alkaloid produced results from a genetic modification to a gene near the psilocybin biosynthetic pathway gene cluster.

Production of Alkaloids in Genetically Modified Organisms

In some embodiments, the genetic modifications described herein allow for the production of alkaloids at increased amounts as measured by % dry weight as compared to that of a comparable unmodified organism (i.e., a wild-type organism). In some cases, the alkaloid is a secondary metabolite. In some embodiments, the genetically modified fungus further comprises a non-naturally occurring alkaloid. In some embodiments, the genetically modified fungus comprises a non-naturally occurring *harmala* alkaloid. In some embodiments, the genetically modified fungus comprises N, N-dimethyltryptamine and a *harmala* alkaloid. In some cases, the alkaloid is a neuroactive alkaloid. In some cases, the alkaloid is a psychotropic alkaloid. In some cases, the alkaloid is a neuroactive alkaloid. In some cases, the alkaloid is a psychotropic alkaloid. In some cases, the alkaloid is a tryptophan-derived alkaloid. For example, the alkaloid can be psilocybin or a derivative or analog thereof. In some cases, the alkaloid is psilocin. In some cases, the alkaloid can be baeocystin. In some cases, the alkaloid can be tryptamine. In some cases, the alkaloid can be 4-hydroxytryptamine. In some cases, the alkaloid can be N,N-dimethyltryptamine. In some cases, the alkaloid can be serotonin. In some cases, the alkaloid can be melatonin. In some cases, the alkaloid can be melanin. In some cases, the alkaloid can be N-acetyl-hydroxytryptamine. In some cases, the alkaloid can be 4-hydroxy-L-tryptophan. In some cases, the alkaloid can be 5-hydroxy-L-tryptophan. In some cases, the alkaloid can be 7-hydroxy-L-tryptophan. In some cases, the alkaloid can be 4-phosphoryloxy-N,N-dimethyltryptamine. In some cases, the alkaloid can be aeruginascin. In some cases, the alkaloid can be 2-(4-Hydroxy-1H-indol-3-yl)-N,N,N-trimethylethan-1-aminium, 4-phosphoryloxy-N,N-dimethyltryptamine. In some cases, the alkaloid can be ketamine. In some cases, the alkaloid can be normelatonin. In some cases, the alkaloid can be 3,4-methylenedioxymethamphetamine. In some cases, the alkaloid can be a β-carboline.

In some embodiments, a combination of alkaloids can be produced at higher concentrations measured by % dry weight. In some cases, the alkaloids include any one or more of psilocybin, norpsilocin, psilocin, tryptamine, 4-hydroxytryptamine, N,N-dimethyltryptamine, baeocystin, norbaeocystin, serotonin, melatonin, melanin, N-acetyl-hydroxytryptamine, 4-hydroxy-L-tryptophan, 5-hydroxy-L-tryptophan, 7-hydroxy-L-tryptophan, 4-phosphoryloxy-N, N-dimethyltryptamine, serotonin, aeruginascin, 2-(4-Hydroxy-1H-indol-3-yl)-N,N,N-trimethylethan-1-aminium, 4-phosphoryloxy-N,N-dimethyltryptamine, ketamine, normelatonin, 3,4-methylenedioxymethamphetamine, β-carboline, or any derivative or any analogue thereof.

For example, in some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of a tryptamine-derivative alkaloid or a tryptophan-derivative alkaloid as measured by dry weight of and as compared to a comparable control without genetic modification.

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of psilocybin, or a derivative thereof, as measured by dry weight and as compared to a comparable control without genetic modification.

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of psilocin as measured by dry weight and as compared to a comparable control without genetic modification.

In some cases, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound, for example, of norpsilocin, psilocybin, pscilocin, or DMT, as measured by dry weight and as compared to a comparable control without genetic modification.

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of norbaeocystin or baeocystin, or a derivative thereof, as measured by dry weight of and as compared to a comparable control without genetic modification.

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of serotonin, melatonin, melanin, N-acetyl-hydroxytryptamine, serotonin, aeruginascin, 2-(4-Hydroxy-1H-indol-3-yl)-N,N,N-trimethylethan-1-aminium, ketamine, normelatonin, 3,4-methylenedioxymethamphetamine, β-carboline, or any derivative thereof, as measured by dry weight and as compared to a comparable control without genetic modification.

In some embodiments, the detection of tryptamine derivatives, or secondary metabolites produced by the genetically modified organism can be characterized by LCMS. In some cases, the detection of tryptamine derivatives, or secondary metabolites produced by the genetically modified organism can be characterized by MALDI-TOF. In some cases, the detection of tryptamine derivatives, or secondary metabolites produced by the genetically modified organism, can be characterized by any comparable analytical technique to LCMS or GCMS.

In some embodiments, the genetically modified organism is analyzed using conventional methods to identify and/or quantify the amount of a secondary metabolite described herein, present in the genetically modified organism.

Production of *Harmala* Alkaloids

Another class of alkaloids also derived from L-tryptophan (4), are the *harmala* alkaloids (e.g., harmane, and harmine) which contain a β-carboline core scaffold. *Harmala* alkaloids have been detected in *P. cubensis* fungi at very low concentrations around 0.2 μg/g. *Harmala* alkaloids are neuroactive compounds that inhibit monoamine oxidase (MAO) which degrades psilocybin in the body. In some instances, a monoamine oxidase can be: an MAO A, an MAO B, or a combination of MAO A and MAO B. In some instances, an inhibitor of MAO A, MAO B, or MAO can be: i) contain any composition or pharmaceutical composition herein; or ii) administered concurrently or consecutively by a same or different route of administration along with a composition or a pharmaceutical composition herein. Thus, the presence of monoamine oxidase inhibitor, which can be a β-carboline-containing alkaloid can contribute to the prevention of psilocybin, or DMT degradation (that is, increased the half life of psilocybin or DMT) in the human body. Thus, the presence of β-carboline-containing alkaloids can contribute to the prevention of DMT degradation in the human body. In some embodiments, inhibition of a PsiH gene can result in an increased production of a *harmala* alkaloid described herein. Exemplary β-carboline containing alkaloids include harmine, harmaline, harmalol, tetrahydroharmine, harmaline, isoharmine, harmine acid methyl ester, harminilic acid, harmanamide, and acetylnorharmine, and derivatives and analogues thereof. In some embodiments, a *harmala* alkaloid is produced by a genetically modified organism described herein. In some embodiments the *harmala* alkaloid can be one of the following:

(30)
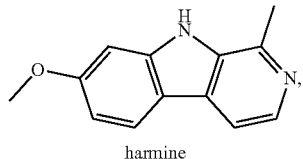
harmine

(31)
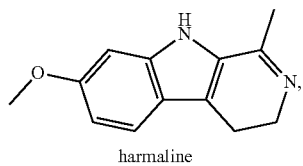
harmaline

(32)
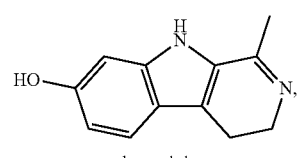
harmalol

(33)
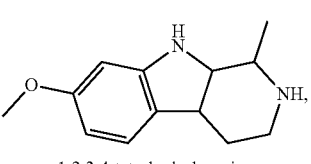
1,2,3,4-tetrahydroharmine

(34)
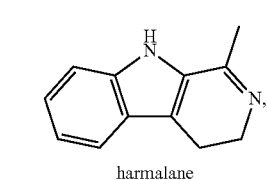
harmalane

(35)
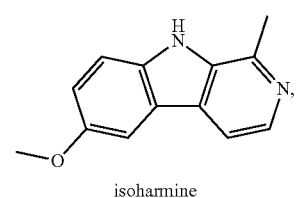
isoharmine

(36)
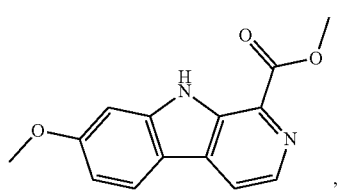
Methyl 7-methoxy-beta-carboline-1-carboxylate

(37)
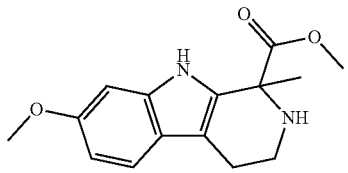
Methyl 7-methoxy-1-methyl-2,3,4,9-tetrahydro-1H-pyrido[3,4-b]indole-1-carboxylate

(38)
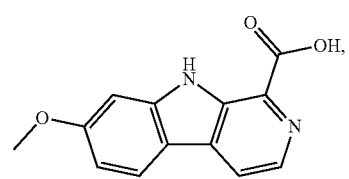
harmanilic acid

(39)
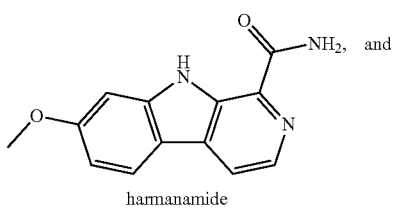
harmanamide

(40)
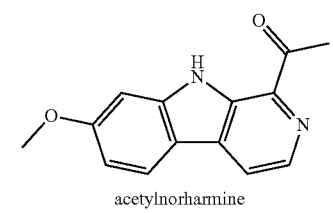
acetylnorharmine

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound harmine, or a derivative thereof, as measured by dry weight of and as compared to a comparable control without genetic modification.

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of harmaline, or a derivative thereof, as measured by dry weight of and as compared to a comparable control without genetic modification.

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of harmalol, or a derivative thereof, as measured by dry weight of and as compared to a comparable control without genetic modification.

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of 1,2,3,4-tetrahydroharmine, or a derivative thereof, as measured by dry weight of and as compared to a comparable control without genetic modification.

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of harmalane, or a derivative thereof, as measured by dry weight of and as compared to a comparable control without genetic modification.

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of isoharmine, or a derivative thereof, as measured by dry weight of and as compared to a comparable control without genetic modification.

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of methyl-7-methoxy-beta-carboline-1-carboxylate, or a derivative thereof, as measured by dry weight of and as compared to a comparable control without genetic modification.

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of methyl-7-methoxy-methyl-2,3,4,9-tetrahydro-1H-pyrido[3,4β]-indole-1-carboxylate, or a derivative thereof, as measured by dry weight of and as compared to a comparable control without genetic modification.

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of harmanilic acid, or a derivative thereof, as measured by dry weight of and as compared to a comparable control without genetic modification.

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of harmanamide, or a derivative thereof, as measured by dry weight of and as compared to a comparable control without genetic modification.

In some embodiments, the genetically modified organism can independently comprise about: 10% 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 100%, 125%, 150%, 175%, 200%, and up to 400% percent more of a compound of acetylnorharmine, or a derivative thereof, as measured by dry weight of and as compared to a comparable control without genetic modification.

In some embodiments, the detection of tryptamine derivatives, or secondary metabolites produced by the genetically modified organism can be characterized by LCMS. In some cases, the detection of tryptamine derivatives, or secondary metabolites produced by the genetically modified organism can be characterized by MALDI-TOF. In some cases, the detection of tryptamine derivatives, or secondary metabolites produced by the genetically modified organism, can be characterized by any comparable analytical technique to LCMS or GCMS.

In some embodiments, the genetically modified organism is analysed using conventional methods to identify and/or quantify the amount of a secondary metabolite described herein, present in the genetically modified organism. In some embodiments, a genetically engineered fungus comprises *harmala* alkaloids (e.g., harmane, and harmine). In some embodiments, the amount of a *harmala* in a genetically engineered fungus described herein has an increased amount of the *harmala* alkaloid in comparison to a comparable wild type fungus.

Modulation of DMT in Genetically Modified Fungi

N, N-dimethyltryptamine (DMT) as described herein can be involved in the psilocybin biosynthesis pathway. Additional approaches to the production of DMT by genetically modified fungi are available by exploiting well-described metabolic and proteomic gene pathways. As described herein, a number of downstream alkaloids are produced by genomic pathways responsible for the biosynthesis of tryptophan. DMT is one such downstream alkaloid of tryptophan. One genomic pathway of particular interest involves targeting indolethylamine-N-methyltransferase (INMT) and TrpM gene sequences. In some embodiments, an engineered fungus described herein comprises over expression of DMT. In some embodiments, an engineered fungus described herein comprises increased production of DMT and an overexpression of a PsiD gene. In some embodiments, an engineered fungus described herein comprises an over expression of an INMT gene and an overexpression of a PsiD gene. In some embodiments, an engineered fungus described herein comprises an over expression of an INMT gene and reduced expression of a PsiH gene. In some embodiments, an engineered fungus described herein comprises an over expression of an INMT gene and reduced expression of a PsiH2 gene. In some embodiments, an engineered fungus described herein comprises an over expression of an INMT gene and reduced expression of a PsiH and a PsiH2 gene. In some embodiments, an engineered fungus described herein produces an increased amount of a rare alkaloid described herein.

In some embodiments, an engineered fungus described herein comprises an over expression of an HsINMT gene and an overexpression of a PsiD gene. In some embodiments, an engineered fungus described herein comprises an over expression of an HsINMT gene and reduced expression of a PsiH gene. In some embodiments, an engineered fungus described herein comprises an over expression of an HsINMT gene and reduced expression of a PsiH2 gene. In some embodiments, an engineered fungus described herein comprises an over expression of an HsINMT gene and reduced expression of a PsiH and a PsiH2 gene. In some embodiments, an engineered fungus described herein produces an increased amount of a rare alkaloid described herein. In some embodiments the HsINMT gene is optimized for *psilocybe* fungi. In some embodiments the HsINMT gene is comprised in an *Ustilago mays* optimized sequence.

In some embodiments, an engineered fungus described herein comprises an over expression of an PcINMT gene and an overexpression of a PsiD gene. In some embodiments, an engineered fungus described herein comprises an over expression of an PcINMT gene and reduced expression of a PsiH gene. In some embodiments, an engineered fungus described herein comprises an over expression of an PcINMT gene and reduced expression of a PsiH2 gene. In some embodiments, an engineered fungus described herein comprises an over expression of an PcINMT gene and reduced expression of a PsiH and a PsiH2 gene. In some embodiments, an engineered fungus described herein produces an increased amount of a rare alkaloid described herein. In some embodiments the PcINMT gene is optimized for *psilocybe* fungi. In some embodiments the PcINMT gene is comprised in an *Ustilago mays* optimized sequence.

In some embodiments, an engineered fungus described herein comprises an over expression of an ZfINMT gene and an overexpression of a PsiD gene. In some embodiments, an engineered fungus described herein comprises an over expression of an ZfINMT gene and reduced expression of a PsiH gene. In some embodiments, an engineered fungus described herein comprises an over expression of an ZfINMT gene and reduced expression of a PsiH2 gene. In some embodiments, an engineered fungus described herein comprises an over expression of an ZfINMT gene and reduced expression of a PsiH and a PsiH2 gene. In some embodiments, an engineered fungus described herein produces an increased amount of a rare alkaloid described herein. In some embodiments the ZfINMT gene is optimized for *psilocybe* fungi. In some embodiments the ZfINMT gene is comprised in an *Ustilago mays* optimized sequence.

In some embodiments, an engineered fungus described herein comprises an over expression of a plant INMT gene and an overexpression of a PsiD gene. In some embodiments, an engineered fungus described herein comprises an over expression of a plant INMT gene and reduced expression of a PsiH gene. In some embodiments, an engineered fungus described herein comprises an over expression of a plant INMT gene and reduced expression of a PsiH2 gene. In some embodiments, an engineered fungus described herein comprises an over expression of a plant INMT gene and reduced expression of a PsiH and a PsiH2 gene. In some embodiments, an engineered fungus described herein produces an increased amount of a rare alkaloid described herein. In some embodiments a plant INMT gene is optimized for *psilocybe* fungi. In some embodiments the plant INMT gene is comprised in an *Ustilago mays* optimized sequence.

In some embodiments, an engineered fungus described herein produces an increased amount of a novel alkaloid described herein. In some embodiments, an engineered fungus described herein produces an increased amount of DMT. In some embodiments, an engineered fungus described herein produces an increased amount of a *harmala* alkaloid. In some embodiments, an engineered fungus described herein produces an increased amount of a *harmala* alkaloid and an increased production of DMT. In some embodiments, a plasmid used herein comprises a human INMT gene. In some embodiments, the human INMT gene is optimized for *Psilocybe cubensis*, and the optimized HsINMT gene comprises the following sequence:
ATGAAAGGAGGATTCACAGGAGGAGATGAATAT-
CAAAAACATTTCCTCCCAAGAGA TTATCTCGCAA-
CATATTATTCTTTCGATGGATCTC-
CATCTCCAGAAGCAGAAATGCTC
AAATTCAACCTCGAATGCCTCCATAAAACAT-
TCGGACCAGGAGGACTCCAAGGAGA TACACT-
CATCGATATCGGATCTGGACCAACAATCTAT-
CAAGTCCTCGCAGCATTCGA
TTCTTTCCAAGATATCACACTCTCTGATTTCACAGA-
TAGAAACAGAGAAGAACTCGA AAAATGGCT-
CAAAAAAGAACCAGGAGCATATGAT-
TGGACACCAGCAGTCAAATTCG
CATGCGAACTCGAAGGAAACTCTGGAAGATGG-
GAAGAAAAAGAAGAAAAACTCAG AGCAGCAGT-
CAAAAGAGTCCTCAAATGCGATGTCCATCTCG-
GAAACCCACTCGCAC
CAGCAGTCCTCCCACTCGCAGATTGCGTCCT-
CACACTCCTCGCAATGGAATGCGCAT
GCTGCTCTCTCGATG-
CATATAGAGCAGCACTCTGCAACCTCG-
CATCTCTCCTCAAAC CAGGAGGACATCTCGT-
CACAACAGTCACACTCAGACTCCCATCTTATATGGT
CGGAA AAAGAGAAT-
TCTCTTGCGTCGCACTCGAAAAAGAAGAAGTCGA
ACAAGCAGTCCTC GATGCAGGATTCGA-
TATCGAACAACTCCTCCATTCTCCACAATCTTAT-
TCTGTCACA AACGCAGCAAACAACG-
GAGTCTGCTTCATCGTCGCAAGAAAAAAACCAGG
ACCA (SEQ ID NO: 190). In some embodiments, the INMT gene is optimized for *Psilocybe cubensis* and the sequence comprises:

(SEQ ID NO: 191)
```
atgaagggcggcttcaccggcggcgacgagtaccagaagc acttcctcccccgcgactacctcgccacctactactcgtt cgacggctcgccctcgcccgaggccgagatgctcaagttc aacctcgagtgcctccacaagaccttcggccccggcggcc tccagggcgacaccctcatcgacatcggctcgggccccac catctaccaggtcctcgccgccttcgactcgttccaggac atcaccctctcggacttcaccgaccgcaaccgcgaggagc tcgagaagtggctcaagaaggagcccggcgcctacgactg gacccccgccgtcaagttcgcctgcgagctcgagggcaac tcgggccgctgggaggagaaggaggagaagctccgcgccg ccgtcaagcgcgtcctcaagtgcgacgtccacctcggcaa ccccctcgcccccgccgtcctcccccctcgccgactgcgtc ctcaccctcctcgccatggagtgcgcctgctgctcgctcg acgcctaccgcgccgccctctgcaacctcgcctcgctcct caagcccggcggccacctcgtcaccaccgtcaccctccgc ctcccctcgtacatggtcggcaagcgcgagttctcgtgcg tcgccctcgagaaggaggaggtcgagcaggccgtcctcga cgccggcttcgacatcgagcagctcctccactcgccccag tcgtactcggtcaccaacgccgccaacaacggcgtctgct tcatcgtcgcccgcaagaagcccggcccctag.
```

In some embodiments, a plasmid used herein comprises a zebrafish INMT gene. In some embodiments the optimized zebrafish INMT gene for *Psilocybe cubensis* comprises:
ATGAGTGAATGCACAAACTTCACAGAAGGAGAAT-
TCTATCAGGCACATTTTGACCC GCGTGCT-
TATGTCAGGAATTTC- TACTCCAGCCCTCGAGGACACTCCGACGAAAAGGATTTCCTTACTTTTGTTTTAGGGGTCTTCAGTAGATTATTTTCAACTGGGAAACACAGA GGGCAAAGGTTGATAGACGTGGGGAGCGGACCATCAATCCACTGCGTCATTAGCGC CTGCGCACACTATGACGAGATTCTTCTGTCTGATTTCTCTGACAACAATCGTAGAGA AATTGAAAAATGGCTAAAAAACCAAGAAGGGTGTCTAGATTGGAGTCCCATCCTCC AGCACGTTAGTAAAACGGAGGGGAAAAGACCGTCCGATTTAGAGGCTACGCTGAAG CAAAGAATCAAAAAGGTTTTAAAATGTGACGTCCGCCTGGAGAATCCGTTTGATCC GCTGACACTGGAACCAGCTGACTGTGTCATTACATCTCTGTGCTTGGAAGCAGCCTG TAAAGACATGCAGATATACCGCCAGGCTTTACATGGGTTGACCAAGCTCCTGTGTCC CGGTGGACTATTCGTCATGGTGGGTGTTCTGAGTGAAACCTTCTACAAGGTGGATGA ACAGCTCTTTTCTTGTCTTAGCCTCAAACAGAATGATATCGAGGAAGCACTGAAAGG TTTTGGCTTCTCTATCCAAGAGTTTAATGTACTACCTGCTGAAGACCAAAACAATTCT GTGTCTGACTTTGAGGCCGTTTTTGTTCTTGTGGCGACCAAGAACATCTGA (SEQ ID NO: 192). In some embodiments, incorporation of an INMT gene described herein into a plasmid is operably linked to a promoter. In some embodiments, incorporation of an INMT gene described herein into a plasmid is operably linked to a terminator. In some embodiments, the terminator sequence comprises:

(SEQ ID NO: 193)
AGTAGATGCCGACCGGATCTGTCGATCGACAAGCTCGAGT

TTCTCCATAATAATGTGTGAGTAGTTCCCAGATAAGGGAA

TTAGGGTTCCTATAGGGTTTCGCTCATGTGTTGAGCATAT

AAGAAACCCTTAGTATGTATTTGTATTTGTAAAATACTTC

TATCAATAAAATTTCTAATTCCTAAAACCAAAATCCAGTA

CTAAAATCCAGATC.

Figure 31A:
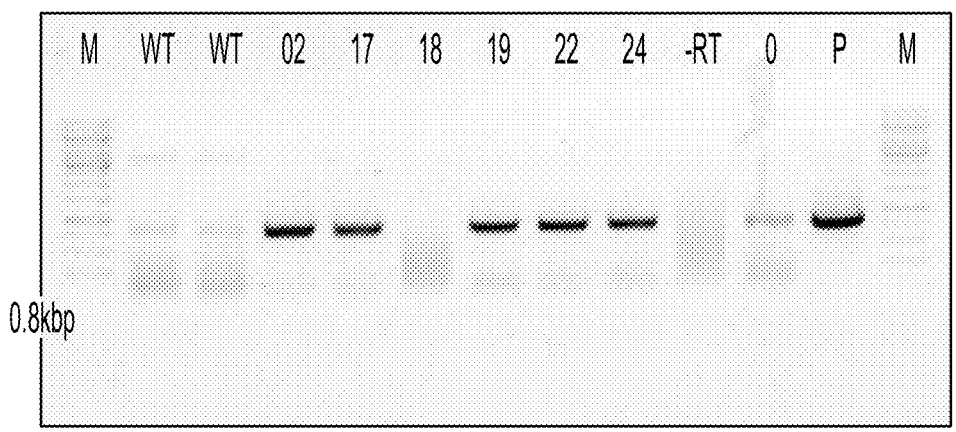
FIG. 31A-31B show an image of a molecular ladder for *Psilocybe cubensis* INMT (FIG. 31A).

*Psilocybe serbica* can mono- and dimethylate L-tryptophan. PsTrpM. In some embodiments, L tryptophan can be metabolically decarboxylated through an L-amino acid decarboxylase (AAAD) gene product. In some embodiments, N,N-dimethyltryptophan (DMTP) is produced by a genetically engineered fungus. In some embodiments, DMTP is metabolically converted to DMT, 5-hydroxy-DMT, or bufotenine. In some embodiments, a genetically modified fungus described herein comprises multiple copies of a transgene described herein. In some embodiments, genetically engineered fungus described herein comprises multiple copies of a transgene described herein. In some embodiments, the transgene is TrpM. In some embodiments, TrpM expression in a genetically engineered fungus is compared the TrpM expression in a comparable wild type fungus. In some embodiments, TrpM expression is evaluated using a molecular ladder comparing a wild-type *psilocybe* fungus with a DMTP expression fungus (FIG. 31A). In some embodiments, TrpM expression is evaluated in arbitrary unites as shown in FIG. 331B.

Figure 31B:
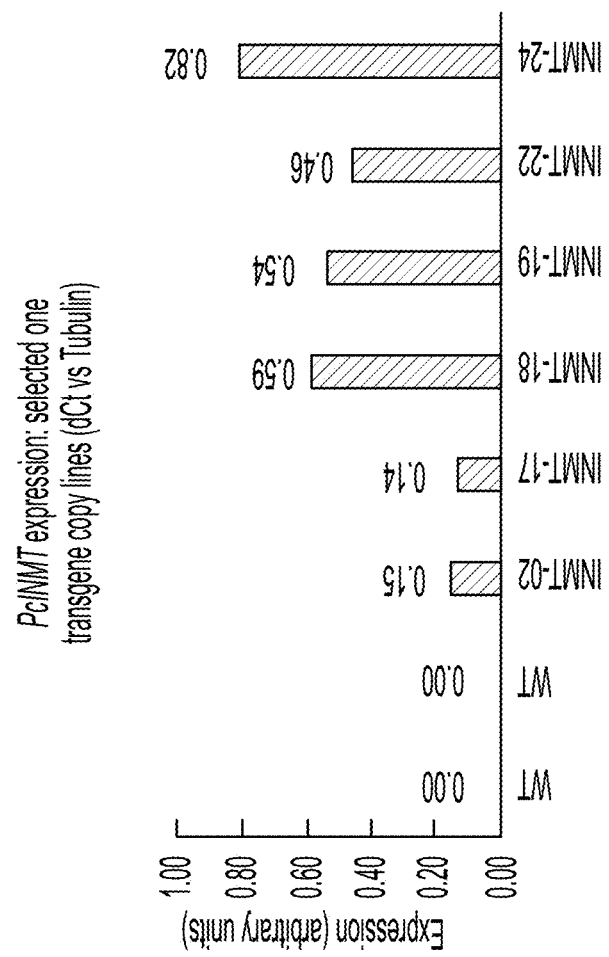
Figure 32A:
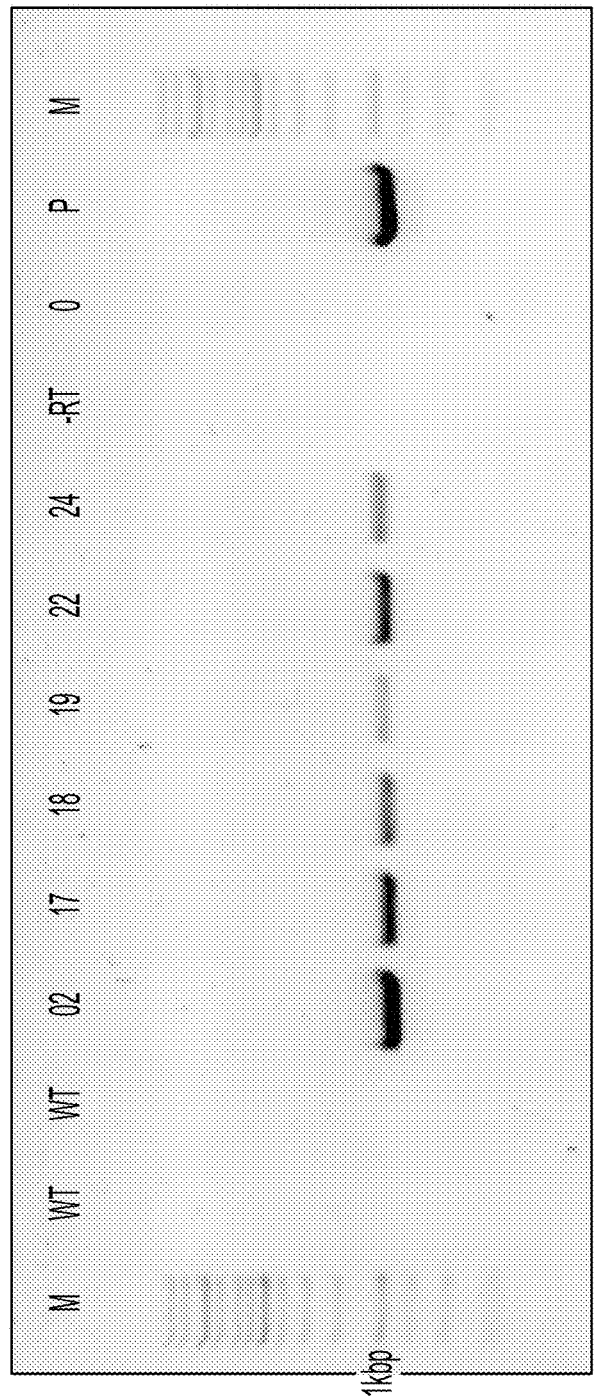
FIG. 32A-32C show analytical representations of TrpM expression using genetically engineered fungi comprising various primer sequences.
Figure 32B:
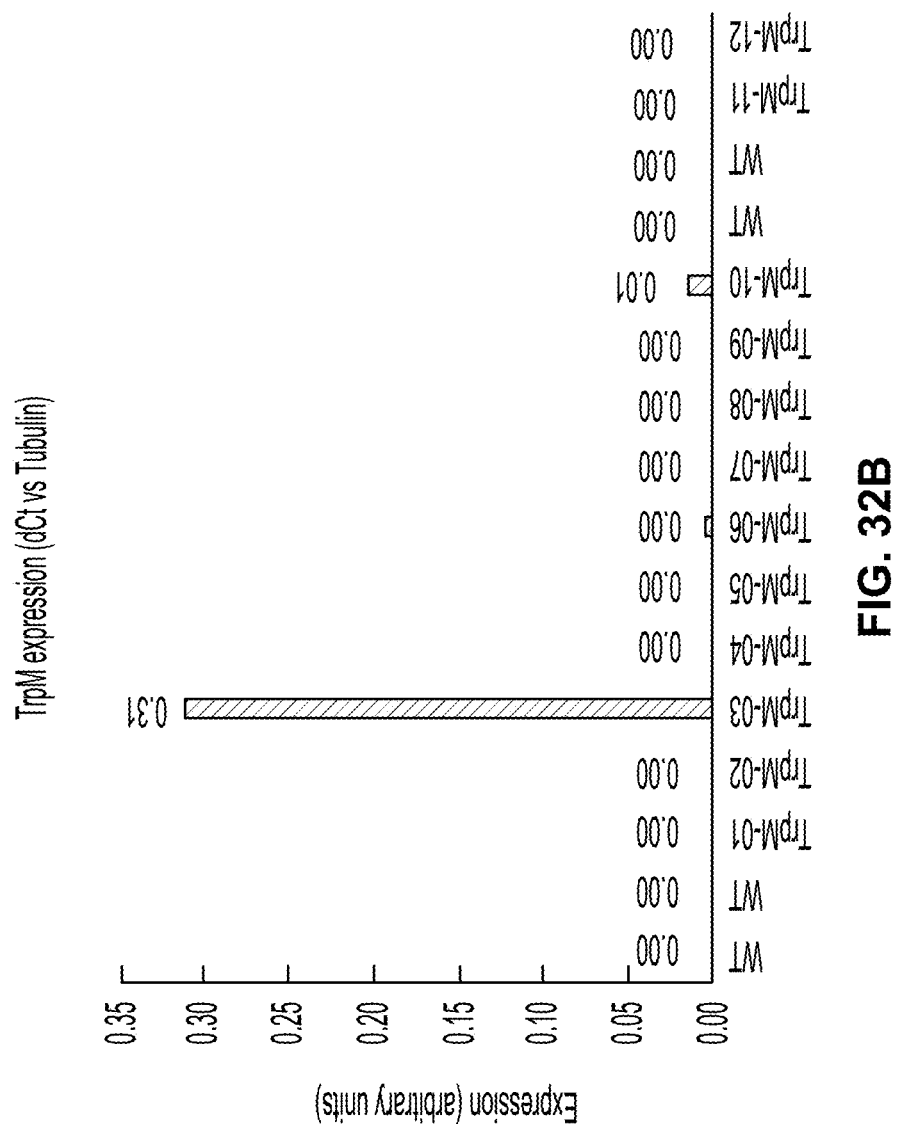
Figure 32C:
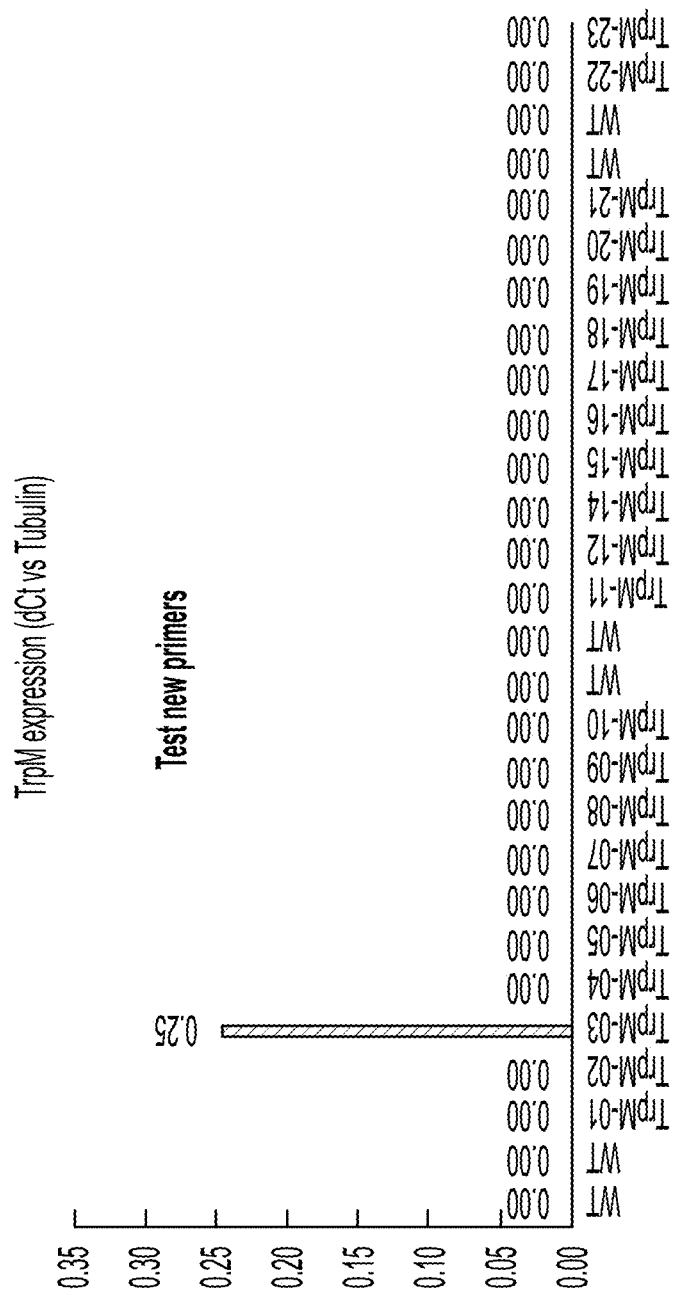

In some embodiments, sequence constructs for gene synthesis and subsequence plasmid preparation can be prepared using gene synthesis methods. In some embodiments, a hygromycin resistance vector can be used as a selection marker in the plasmid. Exemplary vector constructs for alkaloid modulation are shown in TABLE 17A-TABLE 17D. Exemplary vectors used for DMT production in a genetically modified organism are shown in TABLE 18. In some embodiments, human INMT is optimized for expression in fungi (e.g., *Psilocybe* and *Utsilago* codon-optimized versions). In some embodiments, PcINMT is optimized for expression in fungi. In some embodiments, RT-PCR amplification of the full coding sequence of PcINMT which included approximately 789 base pairs. In some embodiments, PcINMT expression is evaluated in arbitrary units as shown in FIGS. 31A-31B.

In some embodiments, a plant construct is used. In some embodiments a fungal construct is used. In some embodiments, a plant construct is a zebrafish construct is used. In some embodiments, a plant construct is a *Xenopus laevis* (Xl) construct is used. In some embodiments, a plant construct is a primate construct is used. In some embodiments, a plant construct is a human construct is used. In some embodiments, testing constructs are used at about: -20 degrees Celsius, -10 degrees Celsius, 0 degrees Celsius, 10 degrees Celsius, 25 degrees Celsius, 30 degrees Celsius, 40 degrees Celsius, 50 degrees Celsius, 60 degrees Celsius, 70 degrees Celsius, or up to about 80 degrees Celsius. In some embodiments amino acids from a PsiD gene can affect INMT protein production. In some embodiments, *Psilocybe* Kozak sequences result in transgene over-expression in *Psilocybe*. In some embodiments, *Psilocybe* Kozak sequences result in transgene under-expression in *Psilocybe*. In some embodiments, a Kozak sequence is a consensus sequence. In some embodiments, a plant construct is used. In some embodiments a fungal construct is used. In some embodiments, a plant construct is a zebrafish construct is used. In some embodiments, a plant construct is a *Xenopus laevis* (Xl) construct is used. In some embodiments, a plant construct is a primate construct is used. In some embodiments, a plant construct is a human construct is used. In some embodiments, testing constructs are used at about: -20 degrees Celsius, -10 degrees Celsius, 0 degrees Celsius, 10 degrees Celsius, 25 degrees Celsius, 30 degrees Celsius, 40 degrees Celsius, 50 degrees Celsius, 60 degrees Celsius, 70 degrees Celsius, or up to about 80 degrees Celsius. In some embodiments amino acids from a PsiD gene can affect INMT protein production. In some embodiments, *Psilocybe* Kozak sequences result in transgene over-expression in *Psilocybe*. In some embodiments, *Psilocybe* Kozak sequences result in transgene under-expression in *Psilocybe*. In some embodiments, a Kozak sequence is a consensus sequence.

TABLE 17A

Exemplary testing constructs to product DMT in fungi

| Construct | Testing constructs to produce DMT in fungi. |
|---|---|
| Construct 1 | AbGPD-i:HsINMT Psilocybe cubensis codon optimised |
| Construct 2 | AbGPD-i:HsINMT Ustilago mays codon optimised |
| Construct 3 | AbGPD-i:Zebra fish INMT |
| Construct 4 | AbGPD-i:Xenopus INMT |

In some embodiments, selected contiguous amino acids from a PsiD gene product are used to modulate INMT production levels in a genetically modified organism. In some embodiments the contiguous amino acids are a chain of: 6, 7, 8, 9, 10, 11, 12, 13, 14, 15, 16, 17, 18, 19, or 20 contiguous amino acids from a PsiD gene. In some embodiments, gene product levels are measured in a mycelium sample of genetically modified organism. In some embodiments INMT inhibition can result from DMT production. In some embodiments allosteric inhibitory binding sites of DMT are removed. In some embodiments, Asp28 (D) and/or Glu34(E) are mutated to and alanine residue. In some embodiments this results in an INMT protein sequence with D28A and/or E34A mutations.

TABLE 17B

Exemplary testing constructs to product DMT in fungi

| Construct | Testing constructs to produce DMT in fungi. |
|---|---|
| Construct 5 | AbGPD-i:PsiDN13-HsINMT |
| Construct 6 | AbGPD-i-Kozak:HsINMT Ustilago mays codon optimised |
| Construct 7 | AbGPD-i:HsINMT with no feedback loop |
| Construct 8 | AbGPD-i:Xenopus INMT |

In some embodiments, *Psilocybe serbica* possessed gene products that can monomethylate and dimethylate L-tryptophan. There are other *Psilocybe* species that do not have gene products to monomethylate and dimethylate L-tryptophan. This originates from a retained ancient duplication event of a portion of the egtDB gene (latter required for ergothioneine biosynthesis). Phylogenetically, this is unrelated to PcPsiM production. In some embodiments, DMTP (N,N,dimethyl-L-tryptophan) can be decarboxylated metabolically into DMT after ingestion in human body through the action of aromatic L-amino acid decarboxylase (AAAD). Many fungal species fungi also have AAAD proteins. In some embodiments, DMTP can metabolize to DMT in *P. cubensis* fruiting body. In some embodiments, the above metabolic process can provide for indirect DMT production in fungi.

TABLE 17C

Exemplary testing constructs to product DMT in fungi

| Construct | Testing constructs to produce DMT in fungi. |
|---|---|
| Construct 9 | AbGPD-i:PsTrpM Psilocybe cubensis codon optimised |
| Construct 10 | AbGPD-i:PsTrpM Psilocybe serbica |

TABLE 17C-continued

Exemplary testing constructs to product DMT in fungi

| Construct | Testing constructs to produce DMT in fungi |
|---|---|
| Construct 11 | AbGPD-i:PsTrpM optimised 1 Psilocybe fungus |

*Harmala* alkaloids inhibit monoamine oxidase (MAO) which can degrade psilocybin and DMT in human body. In some embodiments, psilocybin and DMT are present in genetically modified fungi described herein. In some embodiments, DMT is present with a monoamine oxidase inhibitor. In some embodiments, are fungal species which produce *harmala* alkaloids (i.e., *harmala* alkaloids such as harmane and harmine) but at very low amounts (around 0.2 µg/g). In some embodiments, a genetically modified fungi can produce *harmala* alkaloids. In some embodiments, a genetically modified fungi can product a *harmala* alkaloid in a higher concentration than the amount produced by a naturally occurring fungus of the same species. In some embodiments, the genetically modified fungus is a *Psilocybe* fungus. In some embodiments, the genetically modified fungus is a *Psilocybe* fungus and can produce a *harmala* alkaloid in a higher concentration than the amount produced by a naturally occurring fungus of the same *Psilocybe* species. In nature, *harmala* alkaloids are a component of the entourage of alkaloids in *Psilocybe* fungi. In some embodiments, a gene native, or not native, to a fungus can produce a β-carboline scaffold. In bacteria, β-carboline scaffold is produced from L-tryptophan. In plants, condensation of tryptamine and secologanin (monoterpene) to produce a tetrahydro-β-carboline scaffold.

TABLE 17D

Exemplary testing constructs to product DMT in fungi

| Construct | Testing constructs to produce DMT in fungi. |
|---|---|
| Construct 12 | AbGPD-i:Bacteria McbB Psilocybe cubensis codon optimised |
| Construct 13 | AbGPD-i:Plant STST Psilocybe cubensis codon optimised |
| Construct 14 | AbGPD-i:Bacteria McbB optimised 1 (no sequence for now) |
| Construct 15 | AbGPD-i:Plant STST codon optimised 1 (no sequence for now) |

TABLE 18

Exemplary vector for DMT and INMT modulation in Fungi

| SEQ ID NO: | Name | Sequence |
|---|---|---|
| 694 | >pGPD-i:Homo sapiens INMT_Psilocybe cubensis codon optimised: terminator | GAGGTCCGCAAGTAGATTGAAAGTTCAGTACGTTTTTAA CAATAGAGCATTTTCGAGGCTTGCGTCATTCTGTGTCAG GCTAGCAGTTTATAAGCGTTGAGGATCTAGAGCTGCTGT TCCCGCGTCTCGAATGTTCTCGGTGTTTAGGGGTTAGCA ATCTGATATGATAATAATTTGTGATGACATCGATAGTAC AAAAACCCCAATTCCGGTCACATCCACCATCTCCGTTTT CTCCCATCTACACACAACAAGCTCATCGCCGTTTGTCTC TCGCTTGCATACCACCCAGCAGCTCACTGATGTCGACTT GTAG ATGAAAGGAGGATTCACAGGAGGAGATGAATATCAAA AACATTTCCTCCCAAGAGATTATCTCGCAACATATTATT CTTTCGATGGATCTCCATCTCCAGAAGCAGAAATGCTCA AATTCAACCTCGAATGCCTCCATAAAACATTCGGACCA GGAGGACTCCAAGGAGATACACTCATCGATATCGGATC TGGACCAACAATCTATCAAGTCCTCGCAGCATTCGATTC TTTCCAAGATATCACACTCTCTGATTTCACAGATAGAAA |

TABLE 18-continued

Exemplary vector for DMT and INMT modulation in Fungi

| SEQ ID NO: | Name | Sequence |
| --- | --- | --- |
| | | CAGAGAAGAACTCGAAAAATGGCTCAAAAAAGAACCA
GGAGCATATGATTGGACACCAGCAGTCAAATTCGCATG
CGAACTCGAAGGAAACTCTGGAAGATGGGAAGAAAAA
GAAGAAAAACTCAGAGCAGCAGTCAAAAGAGTCCTCAA
ATGCGATGTCCATCTCGGAAACCCACTCGCACCAGCAG
TCCTCCCACTCGCAGATTGCGTCCTCACACTCCTCGCAA
TGGAATGCGCATGCTGCTCTCGATGCATATAGAGCAG
CACTCTGCAACCTCGCATCTCTCCTCAAACCAGGAGGAC
ATCTCGTCACAACAGTCACACTCAGACTCCCATCTTATA
TGGTCGGAAAAAGAGAATTCTCTTGCGTCGCACTCGAA
AAAGAAGAAGTCGAACAAGCAGTCCTCGATGCAGGATT
CGATATCGAACAACTCCTCCATTCTCCACAATCTTATTC
TGTCACAAACGCAGCAAACAACGGAGTCTGCTTCATCG
TCGCAAGAAAAAACCAGGACCAAGTAGATGCCGACCG
GATCTGTCGATCGACAAGCTCGAGTTTCTCCATAATAAT
GTGTGAGTAGTTCCCAGATAAGGGAATTAGGGTTCCTAT
AGGGTTTCGCTCATGTGTTGAGCATATAAGAAACCCTTA
GTATGTATTTGTATTTGTAAAATACTTCTATCAATAAAA
TTTCTAATTCCTAAAACCAAAATCCAGTACTAAAATCCA
GATC |
| 695 | >pGPD-i:*Homo sapiens* INMT_*Ustilago mays* codon optimised: terminator | GAGGTCCGCAAGTAGATTGAAAGTTCAGTACGTTTTTAA
CAATAGAGCATTTTCGAGGCTTGCGTCATTCTGTGTCAG
GCTAGCAGTTTATAAGCGTTGAGGATCTAGAGCTGCTGT
TCCCGCGTCTCGAATGTTCTCGGTGTTTAGGGGTTAGCA
ATCTGATATGATAATAATTTGTGATGACATCGATAGTAC
AAAAACCCCAATTCCGGTCACATCCACCATCTCCGTTTT
CTCCCATCTACACACAACAAGCTCATCGCCGTTTGTCTC
TCGCTTGCATACCACCCAGCAGCTCACTGATGTCGACTT
GTAG
atgaagggcggcttcaccggcggcgacgagtaccagaagcacttcctccccgcgactac
ctcgccacctactactcgttcgacggctcgccctcgcccgaggccgagatgctcaagttcaa
cctcgagtgcctccacaagaccttcggccccggcggcctccagggcgacaccctcatcga
catcggctcgggcccccaccatctaccaggtcctcgccgccttcgactcgttccaggacatca
ccctctcggacttcaccgaccgcaaccgcgaggagctcgagaagtggctcaagaaggagc
ccggcgcctacgactggaccccgccgtcaagttcgctgcgagctcgagggcaactcgg
gccgctgggaggagaaggaggagaagctccgcgccgcgtcaagcgcgtcctcaagtgc
gacgtccacctcggcaaccccctcgccccgccgtcctcccctcgccgactgcgtcctca
ccctcctcgccatggagtgcgcctgctgctcgctcgacgcctaccgcgccgccctctgcaac
ctcgcctcgctcctcaagcccggcggccacctcgtcaccaccgtcaccctccgcctccctc
gtacatggtcggcaagcgcgagttctcgtgcgtcgccctcgagaaggaggaggtcgagca
ggccgtcctcgacgccggcttcgacatcgagcagctcctccactcgcccagtcgtactcg
gtcaccaacgcgccaacaacggcgtctgcttcatcgtcgcccgcaagaagcccggccct
agAGTAGATGCCGACCGGATCTGTCGATCGACAAGCTCG
AGTTTCTCCATAATAATGTGTGAGTAGTTCCCAGATAAG
GGAATTAGGGTTCCTATAGGGTTTCGCTCATGTGTTGAG
CATATAAGAAACCCTTAGTATGTATTTGTATTTGTAAAA
TACTTCTATCAATAAAATTTCTAATTCCTAAAACCAAAA
TCCAGTACTAAAATCCAGATC |
| 696 | >pGPD-i:Zebra fish INMT: terminator | GAGGTCCGCAAGTAGATTGAAAGTTCAGTACGTTTTTAA
CAATAGAGCATTTTCGAGGCTTGCGTCATTCTGTGTCAG
GCTAGCAGTTTATAAGCGTTGAGGATCTAGAGCTGCTGT
TCCCGCGTCTCGAATGTTCTCGGTGTTTAGGGGTTAGCA
ATCTGATATGATAATAATTTGTGATGACATCGATAGTAC
AAAAACCCCAATTCCGGTCACATCCACCATCTCCGTTTT
CTCCCATCTACACACAACAAGCTCATCGCCGTTTGTCTC
TCGCTTGCATACCACCCAGCAGCTCACTGATGTCGACTT
GTAG
ATGAGTGAATGCACAAACTTCACAGAAGGAGAATTCTA
TCAGGCACATTTTGACCCGCGTGCTTATGTCAGGAATTT
CTACTCCAGCCCTCGAGGACACTCCGACGAAAGGATT
TCCTTACTTTTGTTTTAGGGGTCTTCAGTAGATTATTTTC
AACTGGGAAACACAGAGGGCAAAGGTTGATAGACGTG
GGGAGCGGACCATCAATCCACTGCGTCATTAGCGCCTG
CGCACACTATGACGAGATTCTTCTGTCTGATTTCTCTGA
CAACAATCGTAGAGAAATTGAAAAATGGCTAAAAAACC
AAGAAGGGTGTCTAGATTGGAGTCCCATCCTCCAGCAC
GTTAGTAAAACGGAGGGGAAAAGACCGTCCGATTTAGA
GGCTACGCTGAAGCAAAGAATCAAAAAGGTTTTAAAAT
GTGACGTCCGCCTGGAGAATCCGTTTGATCCGCTGACAC
TGGAACCAGCTGACTGTGTCATTACATCTCTGTGCTTGG
AAGCAGCCTGTAAAGACATGCAGATATACCGCCAGGCT
TTACATGGGTTGACCAAGCTCCTGTGTCCCGGTGGACTA
TTCGTCATGGTGGGTGTTCTGAGTGAAACCTTCTACAAG
GTGGATGAACAGCTCTTTTCTTGTCTTAGCCTCAAACAG |

TABLE 18-continued

Exemplary vector for DMT and INMT modulation in Fungi

| SEQ ID NO: | Name | Sequence |
|---|---|---|
| | | AATGATATCGAGGAAGCACTGAAAGGTTTTGGCTTCTCT<br>ATCCAAGAGTTTAATGTACTACCTGCTGAAGACCAAAA<br>CAATTCTGTGTCTGACTTTGAGGCCGTTTTTGTTCTTGTG<br>GCGACCAAGAACATCTGAAGTAGATGCCGACCGGATCT<br>GTCGATCGACAAGCTCGAGTTTCTCCATAATAATGTGTG<br>AGTAGTTCCCAGATAAGGGAATTAGGGTTCCTATAGGG<br>TTTCGCTCATGTGTTGAGCATATAAGAAACCCTTAGTAT<br>GTATTTGTATTTGTAAAATACTTCTATCAATAAAATTTCT<br>AATTCCTAAAACCAAAATCCAGTACTAAAATCCAGATC |
| 697 | >pGPD-i:<br>Xenopus laevis<br>INMT:terminator | GAGGTCCGCAAGTAGATTGAAAGTTCAGTACGTTTTTAA<br>CAATAGAGCATTTTCGAGGCTTGCGTCATTCTGTGTCAG<br>GCTAGCAGTTTATAAGCGTTGAGGATCTAGAGCTGCTGT<br>TCCCGCGTCTCGAATGTTCTCGGTGTTTAGGGGTTAGCA<br>ATCTGATATGATAATAATTTGTGATGACATCGATAGTAC<br>AAAAACCCCAATTCCGGTCACATCCACCATCTCCGTTTT<br>CTCCCATCTACACACAACAAGCTCATCGCCGTTTGTCTC<br>TCGCTTGCATACCACCCAGCAGCTCACTGATGTCGACTT<br>GTAG<br>atgtatcagtccatgtttgatccaaaaacatatttagcttcttttttgcagttttggaaaagga<br>agagatagaatattgaatttccgcctacagaaatgttttgaaacatttggaccaggtggtgtt<br>ggaggagacactttgattgacataggcagtggtccttcaatctaccaactggcttcagcttgt<br>gaatctttcagaaatataattgccacagatttactgactgtaatcgtcaagaatttcaaaaa<br>tggctaaataatgagccaggatcatttgattggtcagagcttctgcaggctgtttgtaaccta<br>gaaggcaacagagaaaactggagagaaaaggaagacaagttgcgagcaacaatcaaaaaggtt<br>ctgaaatgtgatgtgacaaaaagcaatccactacacccagagattctgcctaaagctgattgt<br>ttgatcagtgctctgtgcttggaagtagcctgtaaagacattgatgcttataaagatgcagtg<br>agaaacataaccacgctgttaaaaccaggaggccatctggtagctattggtgtatttgggg<br>gggatagttttttacaaggt<br>tggcaaacagacattttttctgcttgccattggatgaggagacagttagaaatactgtaataaat<br>gctggttataccattaaagagctggaggtatttcctattgatgatgcttcgttatatggtgac<br>cttacagattgctgtgctaattttttttctcgttgctaagaaaaatctcacataaAGTAGATGCC<br>GACCGGATCTGTCGATCGACAAGCTCGAGTTTCTCCATA<br>ATAATGTGTGAGTAGTTCCCAGATAAGGGAATTAGGGT<br>TCCTATAGGGTTTCGCTCATGTGTTGAGCATATAAGAAA<br>CCCTTAGTATGTATTTGTATTTGTAAAATACTTCTATCAA<br>TAAAATTTCTAATTCCTAAAACCAAAATCCAGTACTAAA<br>ATCCAGATC |
| 698 | >pGPD-i:<br>Psilocybe<br>cubensis<br>PsiD_N13:<br>Ustilago<br>mays codon<br>optimised:<br>terminator | GAGGTCCGCAAGTAGATTGAAAGTTCAGTACGTTTTTAA<br>CAATAGAGCATTTTCGAGGCTTGCGTCATTCTGTGTCAG<br>GCTAGCAGTTTATAAGCGTTGAGGATCTAGAGCTGCTGT<br>TCCCGCGTCTCGAATGTTCTCGGTGTTTAGGGGTTAGCA<br>ATCTGATATGATAATAATTTGTGATGACATCGATAGTAC<br>AAAAACCCCAATTCCGGTCACATCCACCATCTCCGTTTT<br>CTCCCATCTACACACAACAAGCTCATCGCCGTTTGTCTC<br>TCGCTTGCATACCACCCAGCAGCTCACTGATGTCGACTT<br>GTAG<br>ATGCAGGTGATACCCGCGTGCAACTCGGCgtacgtcgttttttattc<br>gctgacttcacccgctaattactataacttgaaaacacagAGCAATAAGAaagggc<br>ggcttcaccggcggcgacgagtaccagaagcacttcctccccgcgactacctcgccacct<br>actactcgttcgacggctcgccctcgcccgaggccgagatgctcaagttcaacctcgagtgc<br>ctccacaagaccttcggccccggcggcctccagggcgacaccctcatcgacatcggctcg<br>ggccccaccatctaccaggtcctcgccgccttcgactcgttccaggacatcaccctctcgga<br>cttcaccgaccgcaaccgcgaggagctcgagaagttggctcaagaaggagcccggcgcct<br>acgactggaccccgccgtcaagttcgcctgcgagctcgagggcaactcgggccgctggg<br>aggagaaggaggagaagctccgcgccgccgtcaagcgcgtcctcaagtgcgacgtccac<br>ctcggcaaccccctcgcccccgccgtcctcccctcgccgactgcgtcctcaccctcctcgc<br>catggagtgcgcctgctgctcgtcgacgcctaccgcgcgccctctgcaacctcgcctcg<br>ctcctcaagccggggccaccctcgtcaccaccgtcaccctccgcctccctcgtacatggt<br>cggcaagcgcgagttctcgtgcgtcgcctcgagaaggaggaggtcgagcaggccgtcct<br>cgacgccggcttcgacatcgagcagctcctccactcgccccagtcgtactcggtcaccaac<br>gccgccaacaacgcgctctgcttcatcgtcgcccgcaagaagcccggcccctagAGTA<br>GATGCCGACCGGATCTGTCGATCGACAAGCTCGAGTTTC<br>TCCATAATAATGTGTGAGTAGTTCCCAGATAAGGGAATT<br>AGGGTTCCTATAGGGTTTCGCTCATGTGTTGAGCATATA<br>AGAAACCCTTAGTATGTATTTGTATTTGTAAAATACTTC<br>TATCAATAAAATTTCTAATTCCTAAAACCAAAATCCAGT<br>ACTAAAATCCAGATC |
| 699 | >pGPD-i-<br>Kozak:HsINMT<br>Ustilago mays<br>codon<br>optimised:<br>terminator | GAGGTCCGCAAGTAGATTGAAAGTTCAGTACGTTTTTAA<br>CAATAGAGCATTTTCGAGGCTTGCGTCATTCTGTGTCAG<br>GCTAGCAGTTTATAAGCGTTGAGGATCTAGAGCTGCTGT<br>TCCCGCGTCTCGAATGTTCTCGGTGTTTAGGGGTTAGCA<br>ATCTGATATGATAATAATTTGTGATGACATCGATAGTAC<br>AAAAACCCCAATTCCGGTCACATCCACCATCTCCGTTTT |

TABLE 18-continued

Exemplary vector for DMT and INMT modulation in Fungi

| SEQ ID NO: | Name | Sequence |
| --- | --- | --- |
| | | CTCCCATCTACACACAACAAGCTCATCGCCGTTTGTCTC<br>TCGCTTGCATACCACCCAGCAGCTCACTGATGTTTCTCC<br>CACC<br>atgaagggcggcttcaccggcggcgacgagtaccagaagcacttcctccccgcgactac<br>ctcgccacctactactcgttcgacggctcgccctcgcccgaggccgagatgctcaagttcaa<br>cctcgagtgcctccacaagaccttcggccccggcggcctccagggcgacaccctcatcga<br>catcggctcgggccccaccatctaccaggtcctcgccgccttcgactcgttccaggacatca<br>ccctctcggacttcaccgaccgcaaccgcgaggagctcgagaagtggctcaagaaggagc<br>ccggcgcctacgactggacccccgccgtcaagttcgcctgcgagctcgagggcaactcgg<br>gccgctggaggagaaggaggagaagctccgcgccgccgtcaagcgcgtcctcaagtgc<br>gacgtccacctcggcaaccccctcgccccgcgtcctccccctcgccgactgcgtcctca<br>ccctcctcgccatggagtgcgcctgctgctcgctcgacgcctaccgcgccgccctctgcaac<br>ctcgcctcgctcctcaagcccggcggccacctcgtcaccaccgtcacctccgcctccctc<br>gtacatggtcggcaagcgcgagttctcgtgcgtcgccctcgagaaggaggaggtcgagca<br>ggccgtcctcgacgccggcttcgacatcgagcagctcctccactcgcccagtcgtactcg<br>gtcaccaacgccgccaacaacggcgtctgcttcatcgtcgcccgcaagaagcccggcccct<br>agAGTAGATGCCGACCGGATCTGTCGATCGACAAGCTCG<br>AGTTTCTCCATAATAATGTGTGAGTAGTTCCCAGATAAG<br>GGAATTAGGGTTCCTATAGGGTTTCGCTCATGTGTTGAG<br>CATATAAGAAACCCTTAGTATGTATTTGTATTTGTAAAA<br>TACTTCTATCAATAAAATTTCTAATTCCTAAAACCAAAA<br>TCCAGTACTAAAATCCAGATC |
| 700 | >pGPD-i:<br>HsINMT<br>*Ustilago mays*<br>codon optimised<br>with no<br>feedback loop:<br>terminator | GAGGTCCGCAAGTAGATTGAAAGTTCAGTACGTTTTTAA<br>CAATAGAGCATTTTCGAGGCTTGCGTCATTCTGTGTCAG<br>GCTAGCAGTTTATAAGCGTTGAGGATCTAGAGCTGCTGT<br>TCCCGCGTCTCGAATGTTCTCGGTGTTTAGGGGTTAGCA<br>ATCTGATATGATAATAATTTGTGATGACATCGATAGTAC<br>AAAAACCCCAATTCCGGTCACATCCACCATCTCCGTTTT<br>CTCCCATCTACACACAACAAGCTCATCGCCGTTTGTCTC<br>TCGCTTGCATACCACCCAGCAGCTCACTGATGTCGACTT<br>GTAGatgaagggcggcttcaccggcggcgacgagtaccagaagcacttcctccccgc<br>gactacctcgccacctactactcgttcGCCggctcgccctcgcccGCCgccgagatgct<br>caagttcaacctcgagtgcctccacaagaccttcggccccggcggcctccagggcgacac<br>cctcatcgacatcggctcgggccccaccatctaccaggtcctcgccgccttcgactcgttcca<br>ggacatcaccctctcggacttcaccgaccgcaaccgcgaggagctcgagaagtggctcaa<br>gaaggagcccggcgcctacgactggacccccgccgtcaagttcgcctgcgagctcgagg<br>gcaactcgggccgctggaggagaaggaggagaagctccgcgccgccgtcaagcgcgt<br>cctcaagtgcgacgtccacctcggcaaccccctcgccccgcgtcctccccctcgccgac<br>tgcgtcctcaccctcctcgccatggagtgcgcctgctgctcgctcgacgcctaccgcgccgc<br>cctctgcaacctcgcctcgctcctcaagcccggcggccacctcgtcaccaccgtcaccctcc<br>gcctcccctcgtacatggtcggcaagcgcgagttctcgtgcgtcgccctcgagaaggagga<br>ggtcgagcaggccgtcctcgacgccggcttcgacatcgagcagctcctccactcgcccag<br>tcgtactcggtcaccaacgccgccaacaacggcgtctgctttcatcgtcgcccgcaagaagc<br>ccggcccctagAGTAGATGCCGACCGGATCTGTCGATCGACA<br>AGCTCGAGTTTCTCCATAATAATGTGTGAGTAGTTCCCA<br>GATAAGGGAATTAGGGTTCCTATAGGGTTTCGCTCATGT<br>GTTGAGCATATAAGAAACCCTTAGTATGTATTTGTATTT<br>GTAAAATACTTCTATCAATAAAATTTCTAATTCCTAAAA<br>CCAAAATCCAGTACTAAAATCCAGATC |
| 701 | >pGPD-i:<br>*Psilocybe<br>serbica* TrpM<br>*Psilocybe<br>cubensis* codon<br>optimised:<br>terminator | GAGGTCCGCAAGTAGATTGAAAGTTCAGTACGTTTTTAA<br>CAATAGAGCATTTTCGAGGCTTGCGTCATTCTGTGTCAG<br>GCTAGCAGTTTATAAGCGTTGAGGATCTAGAGCTGCTGT<br>TCCCGCGTCTCGAATGTTCTCGGTGTTTAGGGGTTAGCA<br>ATCTGATATGATAATAATTTGTGATGACATCGATAGTAC<br>AAAAACCCCAATTCCGGTCACATCCACCATCTCCGTTTT<br>CTCCCATCTACACACAACAAGCTCATCGCCGTTTGTCTC<br>TCGCTTGCATACCACCCAGCAGCTCACTGATGTCGACTT<br>GTAGATGCCAAGAATCCAAGTCCTCGATATCAGAGGAT<br>CTAAAGAATCTGTCGGATCTACACCACATCTCAGAGCA<br>GCAATCCTCGAAGGACTCCTCAAACCACCAGGATCTAG<br>AACACTCCCATCTGAAACACTCTATGATGAAGTCGGACT<br>CAAAATGTATAACGATGGAATGAAAGCATGGGCAGAAT<br>GGTATTATCCAGTCGAAGCAGAAAGACAAATCCTCGAA<br>AGATATGGAAGAGATATCGCAAAACTCTTCACAACATC<br>TGCAAAAGGAAAAGCAGTCCTCATCGAACTCGGAGCAG<br>GATCTCTCGATAAAACATCTCAAGTCCTCCTCTCTGCAG<br>CAGAAATCACAAGAACAACAGGACCAATGAACAACATC<br>GCATATTATGCACTCGATCTCGAAAGAGGAGAACTCGA<br>AAGAACAATCGGAAGACTCCAAGAAGTCATCGGAGATC<br>AAATCGCAGGAAAAATCTCTACAGCAGGAATGTGGGGA<br>ACATATGATGATGGAATCAGAGTCATCGAAAAAAACGA<br>ACTCGAACTCGAACCAGATATCCCAGTCCATATCCTCTT<br>CCTCGGAGGAACAATCGGAAACTTCTCTAAACAAGATG<br>GAGATGTCGCATTCCTCAAATCTCTCCCACTCGATCATA |

TABLE 18-continued

Exemplary vector for DMT and INMT modulation in Fungi

| SEQ ID NO: | Name | Sequence |
|---|---|---|
| | | AAAGAGGAGATACACTCCTCGTCGGAATGGATAGACAT<br>AAATCTGCAGATGCAATCGAAAGATCTTATGGATTCGC<br>AGCAGCAAAAGATTGGATCATGAACGGACTCAAAGTCT<br>CTGGAAGAGTCCTCACAGGAGATGAAGGACTCTTCGAA<br>ATCGGAAACTGGGAAAGATATGCAAAATATAACGAAGA<br>ACTCGGAAGATATGAAGCAGGATATAAATCTCAAAAAG<br>AACATGCACTCAAAATCTCTGAAGGAGTCGATATCACA<br>TTCCTCAAAGATGAAGTCGTCCTCGTCATGTTCTCTAAC<br>AAATATACAGATGCAGAAATGGATTCTGTCGTCGATTCT<br>GCAGGACTCGTCAAAAACGGATCTTGGATGGATGAAAA<br>AGCACAATATTGCCTCCTCTCTCAGAGCAAACAACGG<br>ACCAGTCTGAAGTAGATGCCGACCGGATCTGTCGATCG<br>ACAAGCTCGAGTTTCTCCATAATAATGTGTGAGTAGTTC<br>CCAGATAAGGGAATTAGGGTTCCTATAGGGTTTCGCTCA<br>TGTGTTGAGCATATAAGAAACCCTTAGTATGTATTTGTA<br>TTTGTAAAATACTTCTATCAATAAATTTCTAATTCCTA<br>AAACCAAAATCCAGTACTAAAATCCAGATC |
| 702 | >pGPD-i:<br>Psilocybe<br>serbica<br>TrpM:<br>terminator | GAGGTCCGCAAGTAGATTGAAAGTTCAGTACGTTTTTAA<br>CAATAGAGCATTTTCGAGGCTTGCGTCATTCTGTGTCAG<br>GCTAGCAGTTTATAAGCGTTGAGGATCTAGAGCTGCTGT<br>TCCCGCGTCTCGAATGTTCTCGGTGTTTAGGGGTTAGCA<br>ATCTGATATGATAATAATTTGTGATGACATCGATAGTAC<br>AAAAACCCCAATTCCGGTCACATCCACCATCTCCGTTTT<br>CTCCCATCTACACACAACAAGCTCATCGCCGTTTGTCTC<br>TCGCTTGCATACCACCCAGCAGCTCACTGATGTCGACTT<br>GTAGatgccgcgaatccaggttcttgacatccgaggctcgaaggagtcagtgggttcaa<br>cacccccatctccgggctgcgatccttgaaggtctactgaagccgccagggagtagaacact<br>cccttctgaaacgctctacgatgaggtcggcttgaagatgtacaacgatgggatgaaagcttg<br>ggcagagtggtactacccgtggaagcagaaagacagatcctggagagatacggaagag<br>atatcgcgaagctgttcactacatcggccaaaggcaaagcagtactgattgagcttggagct<br>ggctcgttggataagacgtcgcaggtcttgttgtctgctgctgagattaccaggacgacaggg<br>ccgatgaataacattgcgtactacgcactggatctcgaacgcggtgagctggaacgcacgat<br>tggaaggctccaggaagtcataggtgatcaaattgccggtaagatctcgacggcaggtatgt<br>ggggaacctacgatgatggcattcgcgtgatcgagaaaaacgaactggaactggaacccg<br>acatcccagtacatatcttgttcctgggaggaacaattgggaattttagcaagcaagatggag<br>acgtggctttcttgaagagcttacctttggaccacaagcgcggagacacgctgctagttggaa<br>tggatagacacaaatcggcagatgccatagaacgctcttacggttttgctgctgcaaaggact<br>ggattatgaacggtttgaaggtgtcaggaagggtgcttactggggacgaggggttatttgaaa<br>ttggcaattgggagagatatgccaaatacaacgaagaattaggtcgatatgaggcaggatat<br>aaatcacagaaagaacacgccctcaagatctccgagggtgttgatataacgttcttaaaagac<br>gaggtcgttttagtcatgttctctaacaagtacaccgatgctgagatggatagtgtggtcgaca<br>gtgctggactggtaaaaaatgggtcttggatggacgagaaggctcaatactgcttactctcatt<br>gagagcaaacaatgggccggtctaaAGTAGATGCCGACCGGATCTGT<br>CGATCGACAAGCTCGAGTTTCTCCATAATAATGTGTGAG<br>TAGTTCCCAGATAAGGGAATTAGGGTTCCTATAGGGTTT<br>CGCTCATGTGTTGAGCATATAAGAAACCCTTAGTATGTA<br>TTTGTATTTGTAAAATACTTCTATCAATAAATTTCTAAT<br>TCCTAAAACCAAAATCCAGTACTAAAATCCAGATC |
| 703 | >pGPD-i:McbB<br>Psilocybe<br>cubensis codon<br>optimised:<br>terminator | GAGGTCCGCAAGTAGATTGAAAGTTCAGTACGTTTTTAA<br>CAATAGAGCATTTTCGAGGCTTGCGTCATTCTGTGTCAG<br>GCTAGCAGTTTATAAGCGTTGAGGATCTAGAGCTGCTGT<br>TCCCGCGTCTCGAATGTTCTCGGTGTTTAGGGGTTAGCA<br>ATCTGATATGATAATAATTTGTGATGACATCGATAGTAC<br>AAAAACCCCAATTCCGGTCACATCCACCATCTCCGTTTT<br>CTCCCATCTACACACAACAAGCTCATCGCCGTTTGTCTC<br>TCGCTTGCATACCACCCAGCAGCTCACTGATGTCGACTT<br>GTAGATGAGACAAATCGAAATCGAATGGGTCCAACCAG<br>GAATCACAGTCACAGCAGATCTCTCTTGGGAAAGAAAC<br>CCAGAACTCGCAGAACTCCTCTGGACAGGACTCCTCCC<br>ATATAACTCTCTCCAAAACCATGCACTCGTCTCTGGAAA<br>CCATCTCTATCATCTCATCGCAGATCCAAGACTCGTCTA<br>TACAGAAGCAAGATATAAAGAAGATAGAACAAAATCTC<br>CAGATGGAACAGTCTTCCTCTCTCAACTCCAACATCTCG<br>CAGTCAAATATGGACCACTCACAGAATATCTCCCAGCA<br>GCACCAGTCGGATCTGTCGTCCCAGAAGATATCGATGC<br>ACTCAGAGAAGCAGGAAGAGCATGCTGGAAAGCAGCA<br>TGGGAAACAAAACAACCAATCGAAGTCAGAGTCAGAA<br>GAAAAGGAGAAGCAGTCACAGATTTCGCACTCCCAAGA<br>ACACCACCAGTCGATCATCCAGGAGTCCAAAAACTCGT<br>CGAAGAAATCCAAGATGAAACAGAAAGAGTCTGGATCA |

TABLE 18-continued

Exemplary vector for DMT and INMT modulation in Fungi

| SEQ ID NO: | Name | Sequence |
|---|---|---|
| | | CACCACCAGCAGAAATCGTCGATATGCATCAAGGAAGA<br>ATCGCATCTAGAGCAGGATCTTATGATCAATATTTCTCT<br>ACACTCGTCTTCCTCAACGGAGAAGTCAGACCACTCGG<br>ATATTGCGCACTCAACGGACTCCTCAAAATCTGCAGAA<br>CAACAGATCTCACACTCAACGATCTCAAAAGAATCACA<br>CCAACATTCATCAAAACACCAGCAGAATTCCTCGGATA<br>TACAGGACTCGATACACTCTGGAGATTCACACAACAAG<br>TCCTCACACTCCTCCCAGATGTCGAAACAAGAGAACAA<br>TATTTCGCACTCGTCAACGCACTCGCACTCTATGCAAAC<br>ATGCTCAACACATGGAACCTCCATTTCTTCCCATGGCAA<br>CATGGAACAGATTATAGATATCTCGATGCATGAAGTAG<br>ATGCCGACCGGATCTGTCGATCGACAAGCTCGAGTTTCT<br>CCATAATAATGTGTGAGTAGTTCCCAGATAAGGGAATT<br>AGGGTTCCTATAGGGTTTCGCTCATGTGTTGAGCATATA<br>AGAAACCCTTAGTATGTATTTGTATTTGTAAAATACTTC<br>TATCAATAAAATTTCTAATTCCTAAAACCAAAATCCAGT<br>ACTAAAATCCAGATC |
| 704 | >pGPD-i:STST<br>Psilocybe<br>cubensis codon<br>optimised<br>terminator | GAGGTCCGCAAGTAGATTGAAAGTTCAGTACGTTTTTAA<br>CAATAGAGCATTTTCGAGGCTTGCGTCATTCTGTGTCAG<br>GCTAGCAGTTTATAAGCGTTGAGGATCTAGAGCTGCTGT<br>TCCCGCGTCTCGAATGTTCTCGGTGTTTAGGGGTTAGCA<br>ATCTGATATGATAATAATTTGTGATGACATCGATAGTAC<br>AAAAACCCCAATTCCGGTCACATCCACCATCTCCGTTTT<br>CTCCCATCTACACACAACAAGCTCATCGCCGTTTGTCTC<br>TCGCTTGCATACCACCCAGCAGCTCACTGATGTCGACTT<br>GTAGATGGCAAACTTCTCTGAATCTAAATCTATGATGGC<br>AGTCTTCTTCATGTTCTTCCTCCTCCTCCTCTCTTCTTCTT<br>CTTCTTCTTCTTCTTCTTCTCCAATCCTCAAAAAAATCTT<br>CATCGAATCTCCATCTTATGCACCAAACGCATTCACATT<br>CGATTCTACAGATAAAGGATTCTATACATCTGTCCAAGA<br>TGGAAGAGTCATCAAATATGAAGGACCAAACTCTGGAT<br>TCACAGATTTCGCATATGCATCTCCATTCTGGAACAAAG<br>CATTCTGCGAAAACTCTACAGATCCAGAAAAAAGACCA<br>CTCTGCGGAAGAACATATGATATCTCTTATGATTATAAA<br>AACTCTCAAATGTATATCGTCGATGGACATTATCATCTC<br>TGCGTCGTCGGAAAAGAAGGAGGATATGCAACACAACT<br>CGCAACATCTGTCCAAGGAGTCCCATTCAAATGGCTCTA<br>TGCAGTCACAGTCGATCAAAGAACAGGAATCGTCTATT<br>TCACAGATGTCTCTTCTATCCATGATGATTCTCCAGAAG<br>GAGTCGAAGAAATCATGAACACATCTGATAGAACAGGA<br>AGACTCATGAAATATGATCCATCTACAAAAGAAACAAC<br>ACTCCTCCTCAAAGAACTCCATGTCCCAGGAGGAGCAG<br>AAATCTCTGCAGATGGATCTTTCGTCGTCGTCGCAGAAT<br>TCCTCTCTAACAGAATCGTCAAATATTGGCTCGAAGGAC<br>CAAAAAAAGGATCTGCAGAATTCCTCGTCACAATCCCA<br>AACCCAGGAAACATCAAAAGAAACTCTGATGGACATTT<br>CTGGGTCTCTTCTTCTGAAGAACTCGATGGAGGACAACA<br>TGGAAGAGTCGTCTCTAGAGGAATCAAATTCGATGGAT<br>TCGGAAACATCCTCCAAGTCATCCCACTCCCACCACCAT<br>ATGAAGGAGAACATTTCGAACAAATCCAAGAACATGAT<br>GGACTCCTCTATATCGGATCTCTCTTCCATTCTTCTGTCG<br>GAATCCTCGTCTATGATGATCATGATAACAAAGGAAAC<br>TCTTATGTCTCTTCTTGAAGTAGATGCCGACCGGATCTG<br>TCGATCGACAAGCTCGAGTTTCTCCATAATAATGTGTGA<br>GTAGTTCCCAGATAAGGGAATTAGGGTTCCTATAGGGTT<br>TCGCTCATGTGTTGAGCATATAAGAAACCCTTAGTATGT<br>ATTTGTATTTGTAAAATACTTCTATCAATAAAATTTCTA<br>ATTCCTAAAACCAAAATCCAGTACTAAAATCCAGATC |

*Psilocybe serbica* mono- and dimethylates L-tryptophan, are unlike many other *Psilocybe* fungi. PsTrpM originates from a retained ancient duplication event of a portion of the egtDB gene (latter required for ergothioneine biosynthesis) and is phylogenetically unrelated to PcPsiM.

In some embodiments, DMTP (N,N,dimethyl-L-tryptophan) can be decarboxylated metabolically into DMT after ingestion in human body through the action of aromatic L-amino acid decarboxylase (AAAD). In some embodiments, but because fungi also have AAAD proteins, DMTP can be metabolized to DMT in a *P. cubensis* fruiting body.

In some embodiments, DMT production occurs from an indirect biosynthesis pathway alternative to the Psilocybin biosynthesis pathway.

In some embodiments, the genetically modified organism produces an elevated amount of N,N,-dimethyltryptamine in comparison to the amount of N,N-dimethyltryptamine produced in a naturally occurring otherwise equivalent genetically modified organism. In some embodiments the genetically modified organism expresses a gene product as shown in TABLE 19.

TABLE 19

Exemplary Gene Products for DMT modulation in Genetically Modified Fungi

| SEQ ID NO | Name | Sequence |
|---|---|---|
| 705 | AbGPD-i: HsINMT Psilocybe cubensis codon optimised | MKGGFTGGDEYQKHFLPRDYLATYY SFDGSPSPEAEMLKFNLECLHKTFG PGGLQGDTLIDIGSGPTIYQVLAAF DSFQDITLSDFTDRNREELEKWLKK EPGAYDWTPAVKFACELEGNSGRWE EKEEKLRAAVKRVLKCDVHLGNPLA PAVLPLADCVLTL LAMECACCSLDAYRAALCNLASLLK PGGHLVTTVTLRLPSYMVGKREFSC VALEKEEVEQAVLDAGFDIEQLLHS PQSYSVTNAANNGVCFIVARKKPGP\* |
| 705 | >pGPD-i: Homo sapiens INMT_Ustilago mays codon optimised: terminator | MKGGFTGGDEYQKHFLPRDYLATYY SFDGSPSPEAEMLKFNLECLHKTFG PGGLQGDTLIDIGSGPTIYQVLAAF DSFQDITLSDFTDRNREELEKWLKK EPGAYDWTPAVKFACELEGNSGRWE EKEEKLRAAVKRVLKCDVHLGNPLA PAVLPLADCVLTLLAMECACCSLDA YRAALCNLASLLKPGGHLVTTVTLR LPSYMVGKREFSCVALEKEEVEQAV LDAGFDIEQLLHSPQSYSVTNAANN GVCFIVARKKPGP\* |
| 706 | >pGPD-i: Zebra fish INMT: terminator | MSECTNFTEGEFYQAHFDPRAYVRN FYSSPRGHSDEKDFLTFVLGVFSRL FSTGKHRGQRLIDVGSGPSIHCVIS ACAHYDEILLSDFSDNNRREIEKWL KNQEGCLDWSPILQHVSKTEGKRPS DLEATLKQRIKKVLKCDVRLENPFD PLTLEPADCVITSLCLEAACKDMQI YRQALHGLTKLLCPGGLFVMVGVLS ETFYKVDEQLFSCLSLKQNDIEEAL KGFGFSIQEFNVLPAEDQNNSVSDF EAVFVLVATKNI\* |
| 707 | >pGPD-i: Xenopus laevis INMT terminator | MYQSMFDPKTYLASFCSFGKGRDRI LNFRLQKCFETFGPGGVGSTLIDI GSGPSIYQLASACESFRNIIATDFT DCNRQEFQKWLNNEPGSFDWSELLQ AVCNLEGNRENWREKEDKLRATIKK VLKCDVTKSNPLHPEILPKADCLIS ALCLEVACKDIDAYKDAVRNITTLL KPGGHLVAIGVFGDSFYKVGKQTFF CLPLDEETVRNTVINAGYTIKELEV FPIDDASLYGDLTDCCANFFLVAKK NLT\* |
| 708 | >pGPD-i: Psilocybe cubensis PsiD_N13 Ustilago mays codon opt imised: terminator | MQVIPACNSAAIRKGGFTGGDEYQK HFLPRDYLATYYSFDGSPSPEAEML KFNLECLHKTFGPGGLQGDTLIDIG SGPTIYQVLAAFDSFQDITLSDFTD RNREELEKWLKKEPGAYDWTPAVKF ACELEGNSGRWEEKEEKLRAAVKRV LKCDVHLGNPLAPAVLPLADCVLTL LAMECACCSLDAYRAALCNLASLLK PGGHLVTTVTLRLPSYMVGKREFSC VALEKEEVEQAVLDAGFDIEQLLHS PQSYSVTNAANNGVCFIVARKKPGP\* |
| 705 | >pGPD-i-Kozak: HsINMT Ustilago mays codon optimised: terminator | MKGGFTGGDEYQKHFLPRDYLATYY SFDGSPSPEAEMLKFNLECLHKTFG PGGLQGDTLIDIGSGPTIYQVLAAF DSFQDITLSDFTDRNREELEKWLKK EPGAYDWTPAVKFACELEGNSGRWE EKEEKLRAAVKRVLKCDVHLGNPLA PAVLPLADCVLTLLAMECACCSLDA YRAALCNLASLLKPGGHLVTTVTLR LPSYMVGKREFSCVALEKEEVEQAV LDAGFDIEQLLHSPQSYSVTNAANN GVCFIVARKKPGP\* |
| | >pGPD-i: HsINMT Ustilago mays codon optimised with no feedback loop: terminator | NO SEQUENCE PROVIDED |
| 709 | >pGPD-i: Psilocybe serbica TrpM Psilocybe cubensis codon optimised: terminator | MPRIQVLDIRGSKESVGSTPHLRAA ILEGLLKPPGSRTLPSETLYDEVGL KMYNDGMKAWAEWYYPVEAERQILE RYGRDIAKLFTTSAKGKAVLIELGA GSLDKTSQVLLSAAEITRTTGPMNN IAYYALDLERGELERTIGRLQEVIG DQIAGKISTAGMWGTYDDGIRVIEK NELELEPDIPVHILFLGGTIGNFSK QDGDVAFLKSLPLDHKRGDTLLVGM DRHKSADAIERSYGFAAAKDWIMNG LKVSGRVLTGDEGLFEIGNWERYAK YNEELGRYEAGYKSQKEHALKISEG VDITFLKDEVVLVMFSNKYTDAEMD SVVDSAGLVKNGSWMDEKAQYCLLS LRANNGPV\* |
| 710 | >pGPD-i: Psilocybe serbica TrpM: terminator | KGGFTGGDEYQKHFLPRDYLATYYS FAGSPSPAAEMLKFNLECLHKTFGP GGLQGDTLIDIGSGPTIYQVLAAFD SFQDITLSDFTDRNREELEKWLKKE PGAYDWTPAVKFACELEGNSGRWEE KEEKLRAAVKRVLKCDVHLGNPLAP AVLPLADCVLTLLAMECACCSLDAY RAALCNLASLLKPGGHLVTTVTLRL PSYMVGKREFSCVALEKEEVEQAVL DAGFDIEQLLHSPQSYSVTNAANNG VCFIVARKKPGP\* |
| 711 | >pGPD-i: McbB Psilocybe cubensis codon optimised: terminator | MRQIEIEWVQPGITVTADLSWERNP ELAELLWTGLLPYNSLQNHALVSGN HLYHLIADPRLVYTEARYKEDRTKS PDGTVFLSQLQHLAVKYGPLTEYLP AAPVGSVVPEDIDALREAGRACWKA AWETKQPIEVRVRRKGEAVTDFALP RTPPVDHPGVQKLVEEIQDETERVW ITPPAEIVDMHQGRIASRAGSYDQY FSTLVFLNGEVRPLGYCALNGLLKI CRTTDLTLNDLKRITPTFIKTPAEF LGYTGLDTLWRFTQQVLTLLPDVET REQYFALVNALALYANMLNTWNLHF FPWQHGTDYRYLDA\* |
| 712 | >pGPD-i: STST Psilocybe cubensis codon optimised: terminator | MANFSESKSMMAVFFMFFLLLLSSS SSSSSSSPILKKIFIESPSYAPNAF TFDSTDKGFYTSVQDGRVIKYEGPN SGFTDFAYASPFWNKAFCENSTDPE KRPLCGRTYDISYDYKNSQMYIVDG HYHLCVVGKEGGYATQLATSVQGVP FKWLYAVTVDQRTGIVYFTDVSSIH DDSPEGVEEIMNTSDRTGRLMKYDP STKETTLLLKELHVPGGAEISADGS FVVVAEFLSNRIVKYWLEGPKKGSA EFLVTIPNPGNIKRNSDGHFWVSSS EELDGGQHGRVVSRGIKFDGFGNIL QVIPLPPPYEGEHFEQIQEHDGLLY IGSLFHSSVGILVYDDHDNKGNSYV SS\* |

Pharmaceutical Compositions, Nutraceutical Compositions, Supplement Compositions, Formulations and Methods This disclosure further provides pharmaceutical and/or nutraceutical compositions comprising genetically modified organisms, genetically modified cells, or an extract, a derivative, or product thereof. This disclosure further provides pharmaceutical or nutraceutical reagents, methods of using the same, and methods of making pharmaceutical or nutraceutical compositions comprising genetically modified organisms, genetically modified cells, or an extract, a derivative, or a product thereof.

In some embodiments, a composition comprising a pharmaceutical or nutraceutical composition as disclosed herein can be used for treating or stabilizing conditions or symptoms associated with conditions such as depression, anxiety, post-traumatic stress, addiction or cessation related side-effects such as smoking cessation, and psychological distress including cancer-related psychological distress. In some embodiments, the neurological health condition, disease, or disorder is: a depression, an anxiety, a post-traumatic stress disorder (PTSD), a psychiatric disorder, mental trauma, a mood disorder, a speech disorder, neurodegenerative disease, psychological distress, a compulsion, a compulsive disorder, an obsessive disorder, an expression of a symptom in a neurodivergent individual, cancer-related psychological distress, an addiction, a headache, multiple sclerosis, ameotrophic lateral schlorosis (ALS), Alzheimer's disease, Parkinson's disease a phobia, a dementia, a fear, an eating disorder, an ischemic event, or any combination thereof. Specifically, genetically modified organisms described herein, or an extract, a derivative, or product thereof can be used to alleviate various symptoms associated with mental disorders and conditions.

In some embodiments, compositions comprising the genetically modification organisms described herein can be used to treat particular symptoms. Exemplary symptoms for treatment include pain, nausea, weight loss, wasting, multiple sclerosis, allergies, infection, vasoconstrictor, depression, migraine, hypertension, post-stroke neuroprotection, as well as inhibition of tumor growth, inhibition of angiogenesis, and inhibition of metastasis, antioxidant, and neuroprotectant. In some embodiments, the genetically modified organisms, can be used to treat persistent muscle spasms, including those that are characteristic of multiple sclerosis, severe arthritis, peripheral neuropathy, intractable pain, migraines, terminal illness requiring end of life care, hydrocephalus with intractable headaches, intractable headache syndromes, neuropathic facial pain, shingles, chronic non-malignant pain, causalgia, chronic inflammatory demyelinating polyneuropathy, bladder pain, myoclonus, post-concussion syndrome, residual limb pain, obstructive sleep apnea, traumatic brain injury, elevated intraocular pressure, opioids or opiates withdrawal, and/or appetite loss.

In some embodiments, compositions comprising the genetically modified organisms described herein can comprise a pharmaceutically or nutraceutically relevant compounds and/or extracts, including flavonoids, monoamine oxidase inhibitors and phytosterols (e.g., apigenin, quercetin, cannflavin A, beta.-sitosterol and the like). The compositions of the present disclosure described herein can take the form of solutions, suspensions, emulsion, tablets, pills, capsules, powders, sustained-release formulations and the like, including those adapted for the following: (1) parenteral administration, for example, by subcutaneous, intramuscular, intravenous or epidural injection as, for example, a sterile solution or suspension, or sustained-release formulation; (2) topical application, for example, as a cream, ointment, or a controlled-release patch or spray applied to the skin; (3) intravaginally or intrarectally, for example, as a pessary, cream or foam; (4) ocularly; (5) transdermally; (6) transmucosally; or (7) nasally.

In some embodiments, the compositions described herein further comprise an additional agent selected from at least one of: amyrin, betulinic acid, celastrol, Cesamet (nabilone), marinol (dronabinol; Δ9-THC), Sativex (cannabidiol; Δ9-THC), biochanin A, curcumin, cyanidin, desmodianones, delphinidin, (+)-catechin, falcarinol, 180-Glycyrrhetinic acid, honokiol, isoperrottetin A, kratom, peonidin, pelargonidin, prestimerin, magnolol, malvidin, rutin, 6-methyltetrapterol A, magnolol, micinioside, resveratrol, salvinorin A, yangonin, and 2-arachidonoylgyerol, lysergic acid diethylamide and derivatives and analogues thereof.

In some embodiments, the compositions can be co-administered with an additional agent selected from at least one of: amyrin, betulinic acid, celastrol, Cesamet (nabilone), marinol (dronabinol; Δ9-THC), Sativex (cannabidiol; Δ9-THC), biochanin A, curcumin, cyanidin, desmodianones, delphinidin, (+)-catechin, falcarinol, 180-Glycyrrhetinic acid, honokiol, isoperrottetin A, kratom, peonidin, pelargonidin, prestimerin, magnolol, malvidin, rutin, 6-methyltetrapterol A, magnolol, micinioside, resveratrol, salvinorin A, yangonin, and 2-arachidonoylgyerol, lysergic acid diethylamide and derivatives and analogues thereof.

The pharmaceutical compositions described herein can be formulated as neutral or salt forms. Pharmaceutically acceptable salts include those formed with free amino groups such as those derived from hydrochloric, phosphoric, acetic, oxalic, tartaric acids, etc., and those formed with free carboxyl groups such as those derived from sodium, potassium, ammonium, calcium, ferric hydroxides, isopropylamine, triethylamine, 2-ethylamino ethanol, histidine, procaine, etc.

The compositions disclosed herein can comprise a preservative, e.g., a compound which can be added to the diluent to essentially reduce bacterial action in the reconstituted formulation, thus facilitating the production of a multi-use reconstituted formulation, for example. Examples of potential preservatives include octadecyldimethylbenzyl ammonium chloride, hexamethonium chloride, benzalkonium chloride (a mixture of alkylbenzyldimethylammonium chlorides in which the alkyl groups are long-chain compounds), and benzethonium chloride.

A pharmaceutical composition of the disclosure is formulated to be compatible with its intended route of administration. Examples of routes of administration include, but are not limited to, parenteral, e.g., intravenous, intradermal, subcutaneous, oral, intranasal (e.g., inhalation), transdermal (e.g., topical), transmucosal, and rectal administration. In a specific embodiment, the composition is formulated in accordance with routine procedures as a pharmaceutical composition adapted for intravenous, subcutaneous, intramuscular, oral, intranasal, or topical administration to human beings. Typically, compositions for intravenous administration are solutions in sterile isotonic aqueous buffer.

Where necessary, the composition may also include a solubilizing agent and a local anesthetic such as lignocaine to ease pain at the site of the injection. In some embodiments, the methods of the disclosure can comprise administration of a composition formulated for parenteral administration by injection (e.g., by bolus injection or continuous infusion). Formulations for injection may be presented in unit dosage form (e.g., in ampoules or in multi-dose containers) with an added preservative. The compositions may take such forms as suspensions, solutions or emulsions in oily or aqueous vehicles, and may contain agents such as suspending, stabilizing and/or dispersing agents. Alternatively, the active ingredient may be in powder form for constitution with a suitable vehicle (e.g., sterile pyrogen-free water) before use.

Accordingly, in some embodiments this disclosure can provide a pharmaceutical composition comprising an effective amount of a genetically modified organism, a derivative, or an extract thereof, in combination with a pharmaceutically acceptable excipient, carrier, or diluent.

In some embodiments, the genetically modified organism, derivative, or extracts thereof, as disclosed herein, can be used for vaporization, production of e-juice or tincture for e-cigarettes, or for the production of other consumable products such as edibles, balms, or topical spreads. In some embodiments, a modified composition provided herein can be used as a supplement, for example a food supplement. In some embodiments, the genetically modified organisms, or an extract, or a product thereof can be used to make edibles. Edible recipes can begin with the extraction of one or more alkaloids from the organism, which can then used as an ingredient in various edible recipes. Extraction methods for edibles include extraction into cooking oil, milk, cream, balms, flour and butter. Lipid rich extraction mediums/edibles are believed to facilitate absorption into the blood stream. Lipids may be utilized as excipients in combination with the various compositions provided herein. In other embodiments, compositions provided herein can comprise oral forms, a transdermal form, an oil formulation, an edible food, or a food substrate, an aqueous dispersion, an emulsion, a solution, a suspension, an elixir, a gel, a syrup, an aerosol, a mist, a powder, a tablet, a lozenge, a gel, a lotion, a paste, a formulated stick, a balm, a cream, or an ointment.

In some embodiments, the genetically modified organism, derivative, or extract thereof, as disclosed herein is a functional mushroom. In some embodiments, the genetically modified organism, derivative, or extract thereof, as disclosed herein is formulated with other functional mushrooms, or extracts, thereof. In some embodiments the genetically modified organism, derivative, or extract thereof, as disclosed herein is formulated with a nootropic herb. In some embodiments the genetically modified organism, derivative, or extract thereof, as disclosed herein is formulated with a phytochemical.

Provided herein are also kits comprising compositions of the genetically modified cells disclosed herein. The kits can include packaging, instructions, and various compositions provided herein. In some embodiments, the kits can contain additional compositions used to generate the various plants and portions of plants provided herein such as pots, soil, fertilizers, water, and culturing tools.

In some embodiments, a second therapeutic can be administered concurrently, or consecutively, with any composition or pharmaceutical composition described herein.

Manufacturing Applications

In some embodiments, the genetically modified organism, derivative, or extracts thereof, as disclosed herein, can be used for the constructing biodegradable plastics.

In some embodiments, the biodegradable is a composite material. In some embodiments, the composite material is used for the construction of an automobile. In some embodiments, the composite material is used for the construction of an aeronautical tool or vessel. In some embodiments, the composite material is used for the construction of tool or vessel in the space industry. In some embodiments, the composite material is used for the construction of garment or textile.

In some embodiments, the genetically engineered organism, article, derivative, or extract thereof is used as a biodegradable fuel.

Exemplary Characteristics and Analyses of a Genetically Engineered Fungi

FIG. 1 shows an alkaloid biosynthesis pathway of a genetically modified organism. The exemplary pathway represents an enzymatic route for producing one or more alkaloids with an organism that is genetically modified to host the pathway. The one or more alkaloids produced by the exemplary pathway can include, for example, psilocybin 101, baeocystin 103, norbaeocystin 104, aeruginascin 105, psilocin 102, tryptamine 107, 4-hydroxytryptamine 109, or N,N-dimethyltryptamine 110.

In particular, the genetically modified organism hosting the illustrated pathway can be described as having a genetic modification that results in an increased expression of L-tryptophan decarboxylase 123 as compared to a comparable wild-type organism. The genetic medication can comprise an exogenous nucleic acid encoding one or more copies of a PsiD gene, e.g., SEQ ID NO: 90. In some embodiments, the PsiD gene is driven by a GDP promoter. When the exogenous nucleic acid is expressed in the genetically modified organism, the L-tryptophan decarboxylase 123 can convert L-tryptophan 106 and/or 4-hydroxy-L-tryptophan 108 into tryptamine 107 or 4-hydroxytryptamine 109, respectively. Advantageously, the upregulated expression of L-tryptophan decarboxylase 123 can result in the increased production of 4-hydroxytryptamine 109 and/or tryptamine 107. Because, as illustrated, 4-hydroxytryptamine 109 and tryptamine 107 can be precursors to compounds including psilocybin 101, baeocystin 103, norbaeocystin 104, aeruginascin 105, psilocin 102, and N,N-dimethyltryptamine 110, the increased expression of L-tryptophan decarboxylase 123 can result in the increased production of any one or more of psilocybin 101, baeocystin 103, norbaeocystin 104, aeruginascin 105, psilocin 102, tryptamine 107, 4-hydroxytryptamine 109, or N,N-dimethyltryptamine 110.

As described herein, the genetically modified organism can be further modified to express an elevated level of a gene product encoded by any one of PsiH, PsiK, or PsiM. The activities of gene products encoded by PsiH, PsiK, and PsiM can be inferred from the illustration in FIG. 1, e.g., by following the black arrows underneath the circles labeled with the PsiH, PsiK, and PsiM involved in the illustrated conversion. In some embodiments, the genetically modified organism can be a fungal cell from Basidiomycetes, e.g., a fungal cell from the genus *Psilocybe*.

Figure 2:
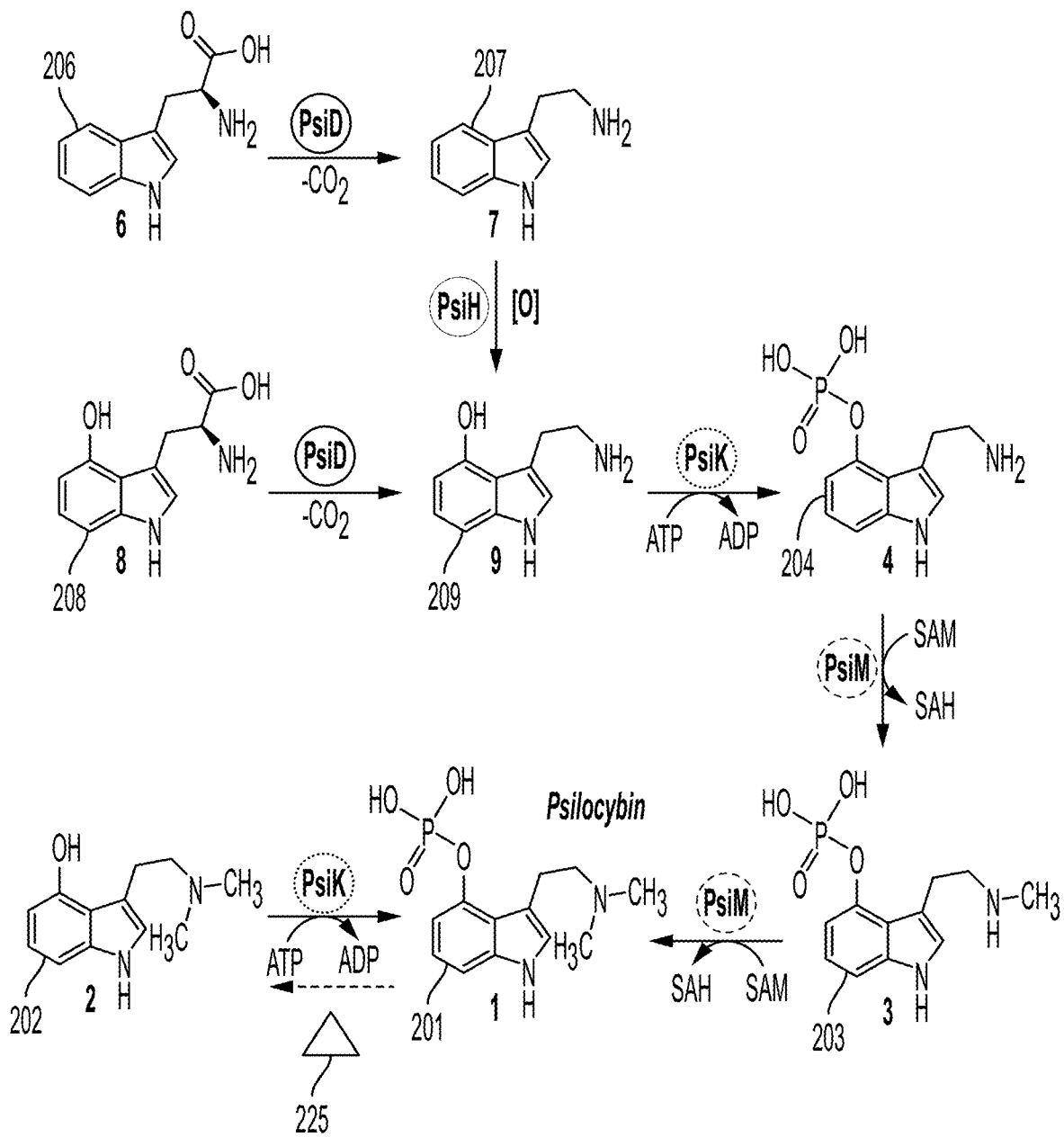
FIG. 2 illustrates a biosynthesis pathway hosted by an organism engineered for producing psilocybin. The organism includes a genetic modification that suppresses psilocybin phosphatase.

FIG. 2 shows a biosynthesis pathway hosted by a genetically modified organism engineered for producing psilocybin. The exemplary pathway can be hosted by a genetically modified organism that is, for example, a fungal cell from the genus *Psilocybe*. The genetically modified organism can be genetically modified to reduce or eliminate expression of psilocybin phosphatase 225, which when expressed in a wild-type fungal cell from the genus *Psilocybe* converts psilocybin 201 into psilocin 202.

By reducing or eliminating expression of psilocybin phosphatase 225, the genetically modified organism can contain an increased amount of psilocybin 201 as compared to a comparable wild-type organism. Without being bound to any one embodiment, in some instances the genetic modification comprises a deletion or an insertion of one or more nucleotides into an endogenous nucleic acid involved in expressing the psilocybin phosphatase 225. For example, the modification can comprise an indel that results in a deleterious disruption of a coding sequence of a gene (e.g., PsiP) encoding the psilocybin phosphatase. In certain embodiments, the genetically modified organism can be further modified to produce increased amounts of additional alkaloids, e.g., baeocystin 203, norbaeocystin 204, aeruginascin 205, tryptamine 207, 4-hydroxytryptamine 209, L-tryptophan 206, 4-hydroxy-L-tryptophan 208 or N,N-dimethyltryptamine 210. For example, the genetically modified organism can be further modified to express an elevated level of a gene product encoded by any one of PsiH, PsiK, or PsiM. The activities of gene products encoded by PsiH, PsiK, and PsiM can be inferred from the illustration in FIG. 2, by following the direction of the black arrow underneath circles labeled by any one of PsiH, PsiK, and PsiM.

Figure 3:
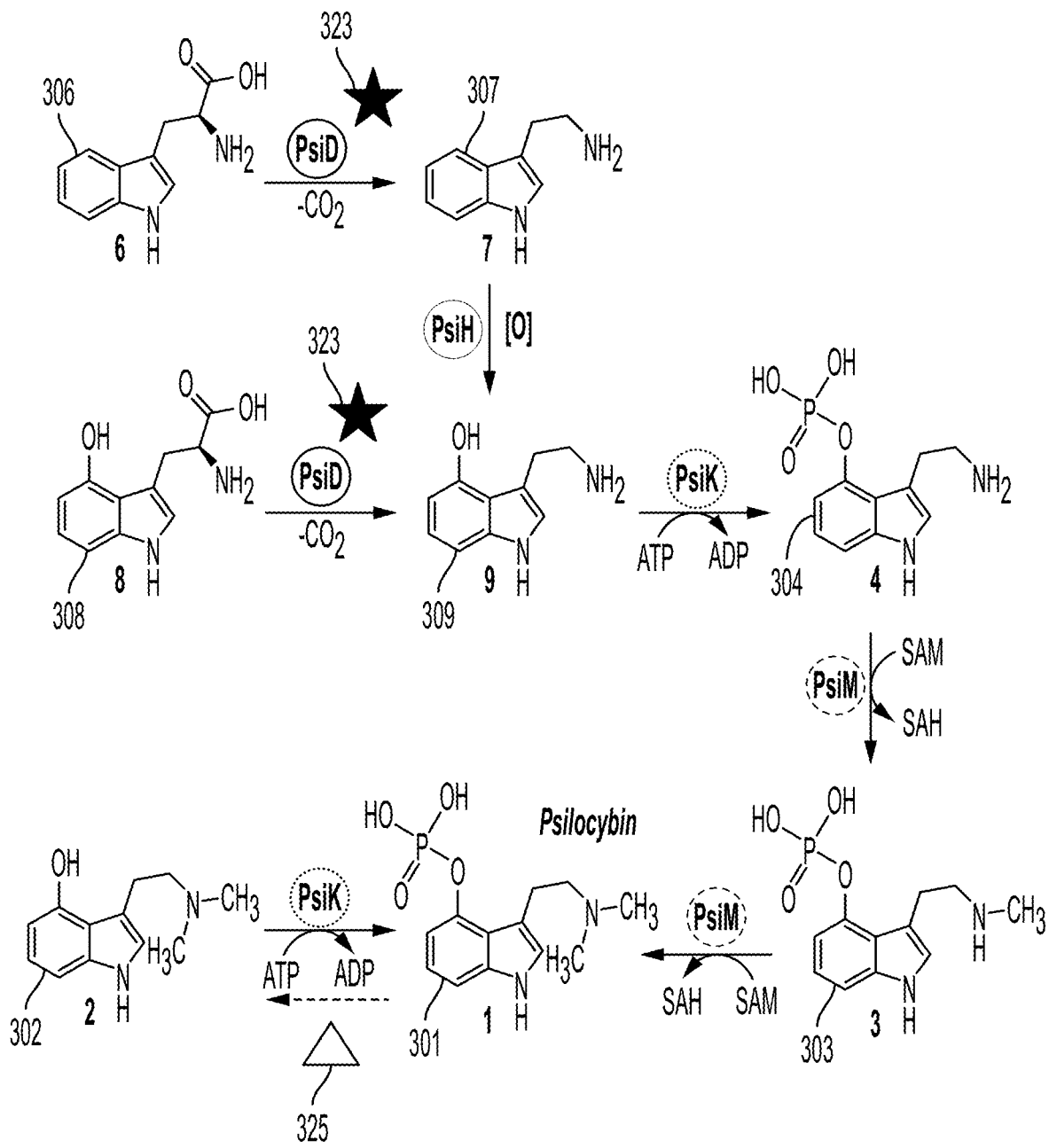
FIG. 3 illustrates an additional alkaloid biosynthesis pathway of a genetically modified organism. The organism includes a genetic modification that upregulates expression of tryptophan decarboxylase and a genetic modification that downregulates expression of psilocybin phosphatase.

FIG. 3 shows an additional alkaloid biosynthesis pathway of a genetically modified organism. The genetically modified organism can be a fungal cell from genus *Psilocybe*. The exemplary pathway represents a route for producing one or more desired alkaloids with a genetically modified organism. The one or more desired alkaloids can include, e.g., psilocybin 301. The one or more desired alkaloids can further include baeocystin 303, norbaeocystin 304, aeruginascin 305, tryptamine 307, 4-hydroxytryptamine 309, or N,N-dimethyltryptamine 310. The genetically modified organism hosting the illustrated pathway can include a genetic modification that results in an increased expression of L-tryptophan decarboxylase 323 as compared to a comparable wild-type organism. When expressed in the genetically modified organism, the L-tryptophan decarboxylase 323 can result in the increased production of any one or more of psilocybin 301, baeocystin 303, norbaeocystin 304, aeruginascin 305, and N,N-dimethyltryptamine 310. The genetically modified organism can further include a second genetic modification that results in decreased expression of psilocybin phosphatase 325, which when expressed in a wild-type fungal cell from the genus *Psilocybe*, converts psilocybin 301 into psilocin 302. Accordingly, by reducing or eliminating expression of psilocybin phosphatase 325, fewer molecules of psilocybin will be converted into psilocin.

Described herein are genetically modified organisms, methods of preparing said genetically modified organisms, and methods of optimizing the production of secondary metabolites for the isolation of psilocybin and derivatives and analogues, thereof. In particular, the present disclosure relates to targeting specific genes and combinations thereof, and subsequently introducing genetic modifications into fungal cells in order to modulate and optimize gene expression important to the psilocybin biosynthetic pathway. In some instances, the introduction of the genetic modifications results in the increase the production of small molecule alkaloids such as psilocybin. Also provided herein are methods of assessing psilocybin production based on cellular phenotype. In some embodiments, phenotypic discrimination of the genetically modified organisms based on alkaloid production may be detected by coloration of exposed or oxidized cellular tissues. In some embodiments, phenotypic discrimination and phenotypic distinction can be used interchangeably. Also provided herein are methods of making genetically modified organisms utilizing gene-editing systems, such as, Clustered Regularly Interspaced Short Palindromic Repeats (CRISPR), Argonaut, zinc-finger, TALEN, *agrobacterium* mediated transformations or other nuclease-based technologies and reagents for generating the genetically modified organisms. Compositions and methods provided herein can be utilized for the generation of fungi or plants with increased tryptamine-derived substance production. Compositions provided herein can be utilized for various uses including but not limited to therapeutic uses, preventative uses, palliative uses, and recreational uses. Methods and genetically modified organisms disclosed herein including methods of modifying fungal cells allowing for the upregulation and downregulation of gene expression which may result in the fungal cells comprising elevated levels of secondary metabolites native to fungal cells.

For example, according to one aspect, this disclosure provides a composition comprising an engineered fungal cell having a modification (e.g., a genetic modification) that results in reduced expression of psilocybin phosphatase in the engineered fungal cell as compared to a comparable fungal cell without said modification. The fungal cell can be from the genus *Psilocybe*. For example, the fungal cell can be from *Psilocybe cubensis* or *Psilocybe cyanescens*. In some embodiments, the composition is in the form of an aerosol, powder, gel, semi-gel, liquid or solid.

The modification can include a deletion or an insertion of one or more nucleotides in a nucleic acid sequence encoding psilocybin phosphatase. For example, the modification can be a deletion or an insertion of one or more nucleotides at a regulatory element involved in expression of psilocybin phosphatase. The deletion or the insertion may result in a frameshift mutation, for example, resulting in a deleterious disruption to the coding sequence of the gene encoding the psilocybin phosphatase. PsiP as used herein, unless stated otherwise, can refer to a PsiP phosphatase family gene or its protein expression product. When a fungus includes multiple PsiP genes, the genes or their protein expression products referenced herein may be numbered to differentiate, e.g., PsiP1 and PsiP2. In some instances, the nucleic acid sequence comprises at least a portion of a nucleotide sequence associated with PsiP, for example, PsiP or PsiP2, and may comprise a sequence that is at least 95% or 100% identical to one of SEQ ID NOS: 15-19.

In some embodiments, the modification can include an exogenous nucleic acid that is incorporated into the engineered fungal cell, wherein the exogenous nucleic acid encodes a gene product that, when expressed, suppresses or eliminates the expression of psilocybin phosphatase in the engineered fungal cell. The gene product can include siRNA or an shRNA, wherein the siRNA or shRNA comprises a nucleic acid sequence that is complementary to mRNA encoding psilocybin phosphatase and thereby silences expression of psilocybin phosphatase by RNA interference. The siRNA or shRNA comprises can include a sequence that is complementary to at least a portion of a mRNA encoded by PsiP or PsiP2.

In some embodiments, the modification can include an exogenous nucleic acid that is incorporated into the engineered fungal cell, wherein the exogenous nucleic acid encodes a gene product that, when expressed, suppresses or eliminates the expression of L-tryptophan-decarboxylase in the engineered fungal cell. The gene product can include siRNA or an shRNA, wherein the siRNA or shRNA comprises a nucleic acid sequence that is complementary to mRNA encoding L-tryptophan-decarboxylase and thereby silences expression of L-tryptophan-decarboxylase by RNA interference. The siRNA or shRNA comprises can include a sequence that is complementary to at least a portion of a mRNA encoded by a PsiD gene.

In some embodiments, the modification can reduce expression of psilocybin phosphatase by at least 50% as compared to a comparable fungal cell without said modification. For example, the modification can reduce the expression of psilocybin phosphatase by 50%, 60%, 70%, 80%, 90%, 95%, or 100% as compared to a comparable fungal cell without said modification. By reducing the expression of psilocybin phosphatase, the modification can result in a decreased expression of psilocin in the engineered fungal cell as compared to a comparable fungal cell without the modification, e.g., a fungal cell from *Psilocybe cubensis* with wild-type normal expression level of psilocybin phosphatase. Accordingly, the modification can result in an increased expression of psilocybin in the engineered fungal cell as compared to a comparable fungal cell without the modification.

In some embodiments, the engineered fungal cell further comprises a second modification that results in at least one of: increased tryptophan decarboxylation, increased tryptamine 4-hydroxylation, increased 4-hydroxytryptamine O-phosphorylation, or increased psilocybin production via sequential N-methylations as compared to a comparable fungal cell without the second modification. For example, the engineered fungal cell can further comprise a second modification that results in an increased expression of a gene product as compared to a comparable fungal cell without the second modification, wherein the gene product is encoded by a gene selected from the group consisting of PsiD, PsiM, PsiH, PsiH2, PsiK, and PsiR. In some embodiments, the engineered fungal cell can further comprise a second modification that results in an increased expression of a gene product as compared to a comparable fungal cell without the second modification, wherein the gene product is encoded by a gene selected from the group consisting of PsiD, PsiM, PsiH, PsiH2, PsiK, PsiM, TrpE, TrpM, PsiL, PsiP, PsiP2, PsiH2 and PsiR. In some embodiments, the engineered fungal cell can further comprise a second modification that results in an increased expression of a gene product as compared to a comparable fungal cell without the second modification, wherein the gene product is encoded by a gene selected from the group consisting of PsiD, PsiM, PsiH, PsiH2, PsiK, PsiM, TrpE, TrpM, PsiL, PsiP, PsiP2, PsiH2, PsiR, and a combination of any of these. The gene product can include, for example, at least a portion of any amino acid listed in TABLE 3.

In some embodiments, the second modification can be an exogenous nucleic acid that is incorporated into the engineered fungal cell, wherein the exogenous nucleic acid includes a sequence that is at least 80%, 90%, 95%, or 100% identical to any one of SEQ ID NOS: 1-19 or 90-98. In other instances, the exogenous nucleic acid includes a sequence that is at least 75%, 80%, 85%, 90%, 99% or 100% identical to any one of SEQ ID NOS: 1-19 or 90-98. In some instances, the exogenous nucleic acid includes a sequence that is at least 75%, 80%, 85%, 90%, 95%, 99% or 100% identical to one of the sequences of TABLE 2 or TABLE 3. In some instances, the exogenous nucleic acid includes a sequence that is at least 75%, 80%, 85%, 90%, 95%, 99% or 100% identical to one of the sequences of TABLE 2.

In some embodiments, any one of SEQ ID NOS: 1-28 comprises a base edit. In some embodiments, the any one of SEQ ID NOS: 1-28 is incorporated using a Cas protein or Cas fusion protein.

As a result of the genetic modification, the engineered fungal cell may express a gene product by at least 6-fold greater than as expressed in a comparable fungal cell without the second modification. For example, the engineered fungal cell may express a gene product (e.g., mRNA encoding tryptophan decarboxylase) by at least 10-fold greater than as expressed in a comparable wild-type fungal cell. To assess the expression of the gene product, a qPCR or western blot analysis can be performed.

The exogenous nucleic acid can include a gene promoter that is positioned upstream of the gene for which upregulated expression is desired. The gene can be any one of PsiD, PsiM, PsiH, PsiK, or PsiR. The gene promoter can be any one of a 35S promoter, a GDP promoter, or a CcDED1 promoter. The gene can be any one of PsiD, PsiM, PsiH, PsiH2, PsiK, PsiM, TrpE, TrpM, PsiL, PsiP, PsiP2, PsiH2 and PsiR. The gene promoter can be any one of a 35S promoter, a GDP promoter, or a CcDED1 promoter.

In some embodiments, this disclosure provides a pharmaceutical composition comprising the engineered fungal cell or an extract thereof. The pharmaceutical composition can include an effective amount of the engineered fungal cell or the extract thereof for treating a health condition. The composition can be formulated such that an effective amount of the composition for treatment of the health condition can be delivered in a single dose format. In other instances, this disclosure provides a supplement comprising an extract of the engineered fungal cell. In yet other instances, this disclosure provides a food supplement comprising an extract of the engineered fungal cell.

The modification can be accomplished by contacting a fungal cell, e.g., a fungal protoplast, with a gene editing system. The gene editing system can be any one of a Cas endonuclease, an *agrobacterium*-mediated insertion of exogenous nucleic acid, TALE-nuclease, a transposon-based nuclease, a zinc finger nuclease, a mega nuclease, a megaTAL or DNA guided nuclease. For example, in some instances the gene editing system is a nucleic acid guided endonuclease (e.g., Cas9), which is delivered into the fungal cell as in the format of an active ribonucleoprotein. The gene editing system can be delivered into the fungal cell in an active form with, for example, a detergent such as Triton X-100. In some embodiments, the gene-editing system includes a nuclear localization signal to facilitate the passage of the gene-editing system into a nucleus of the fungal cell.

In one aspect, provided herein is a composition comprising an engineered fungal cell including a genetic modification that results in at least a 6-fold increase in expression of mRNA encoding L-tryptophan decarboxylase in the engineered fungal cell as compared to a comparable fungal cell that is devoid of said genetic modification, wherein the fungal cell is from division Basidiomycota. For example, the fungal cell can be a mycelium. The composition can be formulated in an effective amount for oral, topical, or intestinal delivery.

Without limiting the scope of this disclosure, the genetic modification can include an exogenous nucleic acid that is integrated into the engineered fungal cell, wherein the exogenous nucleic acid comprises one or more genes and at least one of the one or more genes encodes L-tryptophan decarboxylase. For example, the exogenous nucleic acid can include 1, 2, 3, 4, 5, or more copies of a gene encoding L-tryptophan decarboxylase. At least one of the one or more genes can have a sequence that is at least 95% identical to SEQ ID NO: 1. In other instances, at least one of the one or more genes can have a sequence that is at least 75%, 80%, 85%, 90%, 99%, or 100% identical to SEQ ID NO: 1. In some embodiments, the exogenous nucleic acid can include 1, 2, 3, 4, 5, or more copies of a gene encoding L-tryptophan decarboxylase. At least one of the one or more genes can have a sequence that is at least 95% identical to SEQ ID NO:

90. In other instances, at least one of the one or more genes can have a sequence that is at least: 75%, 80%, 85%, 90%, 99%, or 100% identical to SEQ ID NO: 90.

In some embodiments, the exogenous nucleic acid includes a promoter that is located upstream of the one or more genes, wherein the promoter comprises one of a 35S promoter, a GPD promoter, or a CcDED1 promoter. The exogenous nucleic acid can include a promoter sequence that is upstream of a sequence that is at least 95% identical to SEQ ID NO: 1. The exogenous nucleic acid can include a promoter sequence that is upstream of a sequence that is at least 95% identical to SEQ ID NO: 90. The exogenous nucleic acid sequence can be integrated into a chromosome of the engineered fungal cell. For example, the exogenous nucleic acid can be integrated into the chromosome at a region involved in regulation of psilocybin synthesis.

As a result of the genetic modification, the engineered fungal cell may have a phenotype that is visually distinct from a comparable fungal cell that is devoid of said genetic modification, wherein the phenotype comprises a color of blue. For example, engineered fungal cell may reflect light having a wavelength of between about 450 and 500 nanometers.

In some embodiments, genetic modification results in an increased expression of psilocybin in the fungal cell as compared to a comparable fungal cell without said genetic modification. The engineered fungal cell further may further include a second modification that results in one of increased tryptamine 4-hydroxylation, increased 4-hydroxytryptamine O-phosphorylation, increased psilocybin production via sequential N-methylations, or decreased psilocybin dephosphorylation as compared to a comparable fungal cell without the second modification. For example, the engineered fungal cell can further include a second modification that results in an increased expression of a gene product as compared to a comparable fungal cell without the second modification, wherein the gene product is involved in psilocybin synthesis and is encoded by any one of PsiM, PsiH, PsiH2, PsiK, or PsiR. For example, the engineered fungal cell can further include a second modification that results in an increased expression of a gene product as compared to a comparable fungal cell without the second modification, wherein the gene product is involved in psilocybin synthesis and is encoded by any one of PsiM, PsiH, PsiH2, PsiK, PsiL, PsiP, PsiP2, TrpE, or PsiR. The gene product can be upregulated by at least 6-fold as compared to a comparable fungal cell without the second modification.

This disclosure further provides for a pharmaceutical composition comprising the engineered fungal cell or an extract thereof. The pharmaceutical composition can comprise a pharmaceutically acceptable carrier. The pharmaceutically acceptable carrier can be formulated in dosage form for topical, oral, inhalation, or intestinal delivery. The pharmaceutical composition can be formulated such that an effective amount of the composition for treating a health condition can be delivered in a single dose format to a subject in need thereof. For example, the health condition can be any one of depression, anxiety, post-traumatic stress, addiction, or psychological distress including cancer-related psychological distress.

In one aspect, this disclosure provides a composition including an engineered fungal cell comprising: a first genetic modification that results in increased expression of L-tryptophan decarboxylase in the engineered fungal cell as compared to a comparable fungal cell without the first genetic modification; and a second genetic modification that results in decreased expression of psilocybin phosphatase in the engineered fungal cell as compared to a comparable fungal cell without the second genetic modification. The fungal cell can be from *Psilocybe cubensis* or *Stropharia cubensis*.

In some embodiments, the first genetic modification includes an exogenous nucleic acid that is incorporated in the engineered fungal cell, wherein the exogenous nucleic acid encodes L-tryptophan decarboxylase. For example, the exogenous nucleic acid can include a sequence that is at least 95% identical to SEQ ID NO: 1. For example, the exogenous nucleic acid can include a sequence that is at least 95% identical to SEQ ID NO: 90. The exogenous nucleic acid further includes a sequence that is a gene promoter, wherein the gene promoter comprises any one of a 35S promoter, a GPD promoter, or a CcDED1 promoter.

In some embodiments, the second genetic modification can involve a deletion of at least a portion of an endogenous nucleic acid sequence that encodes psilocybin phosphatase. The endogenous nucleic acid sequence can have a sequence that is at least, for example, 95% identical to SEQ ID NO: 1. The endogenous nucleic acid sequence can have a sequence that is at least, for example, 95% identical to SEQ ID NO: 90. In other instances, the second genetic modification can involve an indel within a promoter or an enhancer of a gene that encodes psilocybin phosphatase. The second genetic modification can include an insertion of an exogenous nucleic acid sequence into the engineered fungal cell, wherein the exogenous nucleic acid sequence encodes a gene product that, when expressed, suppresses or eliminates the expression of mRNA encoding psilocybin phosphatase.

In some embodiments, the first genetic modification results in at least a 6-fold increase in expression of L-tryptophan decarboxylase in the engineered fungal cell as compared to a comparable fungal cell that is devoid of said first genetic modification. The second genetic modification suppresses expression of psilocybin phosphatase by at least 50% as compared to a comparable fungal cell without said second genetic modification.

In one aspect, this disclosure provides a composition including an engineered fungus comprising: a genetic modification that results in an increased expression of L-tryptophan decarboxylase such that the engineered fungus or a portion thereof changes from a first color to a second color upon exposure to air, wherein the second color is visually distinct from a color of a corresponding portion of a comparable fungus without the genetic modification upon an equivalent exposure of air. For example, the second color may be a result of the fungus reflecting light having a wavelength between about 450 and 500 nanometers.

In some embodiments, the genetic modification comprises an exogenous nucleic acid encoding one or more genes. The one or more genes preferable encode L-tryptophan decarboxylase. In certain instances, the exogenous nucleic acid can be incorporated into the engineered fungus with a vector. For example, such as one of the vectors or plasmids listed in TABLE 20A. The vector can be elected from the group consisting of pGWB5, pGHGWY, and pGHGWY. Exemplar promoter sequences are further shown in TABLE 20B, TABLE 21A, and TABLE 21B.

TABLE 20A

Exemplary gene expression vectors.

| Vector | Gene Promoter | Gene Inserted | Promoter characteristics |
|---|---|---|---|
| pGWB5 | 35S | PsiH/PsiD/PsiK/PsiH | Califlower mosaic virus 35S promoter |

TABLE 20A-continued

Exemplary gene expression vectors.

| Vector | Gene Promoter | Gene Inserted | Promoter characteristics |
|---|---|---|---|
| pGHGWY | GPD | PsiH/PsiD/PsiK/PsiH | Fungal specific promoters |
| pGHGWY | CcDED1 | PsiH/PsiD/PsiK/PsiH | Fungal specific promoters |

TABLE 20B

Exemplary GPD and pU6 promoter sequences.

| SEQ ID NO. | Gene Promoter | Sequence |
|---|---|---|
| 165 | GPD Promoter | Gaggtccgcaagtagattgaaagttcagtacgtttttaacaatagagcattttcgaggctgcgtcattctgtgtcaggctagcagtttataagcgttggatctagagctgctgttccgcgtctcgaatgttctcggtgtttaggggttagcaatctgatatgataataatttgtgatgacatcgatagtacaaaaaccccaattccggtcacatccaccatctccgttttctccatctacacacaacaagctcatcgcc |
| 250 | pU6-1 promoter | CGATTTCTTTAGGGCCGTAGGCTAGTAATCATCGACCGTTTTAATCATTAATGTACTTAGACAATAAATATAAGATGCAATACAAGTCAATGGGAGAAACTAGACTTTACAAAACCTTTAAAAGCCCTGGTGAGATATGAGAAGGTTTATGACAGAATATATCGCCATTAATGTGAGGTTGTGGACACTGCTGGTAGTCAAGGCTGCCCGTGAACCATATTTAGTCACATGTAATCACCCCGCGTGCTAAACAAAAGCAAAATATCAGTAAGATAGTCACAGTCATAACACTGTTGAAT |
| 251 | pU6-2 promoter | TGCCAAAAAGCCTTCTTGTGGCCTGCTTACTATTAAGGCAACTAATTCAAGAACAAGTGATTCTGGGTAGGTAGATGCCACAGTTCATGATAATAAGGCGAAGTCAGAAGGAGTAGTCCGTTGATGAAGAAAGCAGAAGGCAAGGAATGTTGGTGGCTTTTGGTTGCGGTAGCACTGAAACCGTGTCCGGACTTCGCCGGGAGCAGACAATGGCTTGGTTGGATTACATAATAATACCCCGCGGGCCAGACAATATTCAAAATCCTAACAAAGATGTCTCAGGTAATACATTCGCTAAT |
| 252 | pU6-11 promoter | GGTACCAGCAGTACCAGCACCAGCCACTGCATTATTGAATCTGACATCTGCAACAGCAAGGTACAATTTTTGTTTTACATTTTACTCATTAATATTAGCACCTATAGCTGTGGCCAATCTTTTGACGACGACTCTCTCACGCTGGAGGAAAGCATGGTACGGGCATTAATTGCCAGCGTAGAACAAGCTAGGATATGGGCAACCTCGCTGATTTCTATATTTGGTAAGAAGTCTCACCCCGTGAGCTAAGCAAAAAGCA |

TABLE 20B-continued

Exemplary GPD and pU6 promoter sequences.

| SEQ ID NO. | Gene Promoter | Sequence |
|---|---|---|
| | | AAACCCTTGCTATGTCAACATCCCACTGCCATACACTATT |
| 253 | GPD promoter (2) | GAGCTCTGAAAGACGCAGCCGACGGTAAACACCCGGGCATCGAGAAAGGCATTGTCGACTATACGGAAGAAGACGTTGTTTCCACCGATTTCGTTGGGAGCAACTATTCGATGATCTTTGACGCAAAGCGGGCATCGCGTTGAACTCGCGTTTTATGAAATTAGTTGCATGGTATGATAATGAGTGGGGATATGCGCGTAGAGTCTGCGATGAGGTTGTGTATGTAGCGAAGAAGAATTAAGAGGTCCGCAAGTAGATTGAAAGTTCAGTACGTTTTTAACAATAGAGCATTTTCGAGGCTTGCGTCATTCTGTGTCAGGCTAGCAGTTTATAAGCGTTGAGGATCTAGAGCTGCTGTTCCCGCGTCTCGAATGTTCTCGGTGTTTAGGGGTTAGCAATCTGATATGATAATAATTTGTGATGACATCGATAGTACAAAACCCCAATTCCGGTCACATCCACCATCTCCGTTTTCTCCCATCTACACACAACAAGCTCATCGCCggtaccATGGTTTGTCTCTCGCTTGCATACCACCCAGCAGCTCACTGATGTCGACTTGTAGGTTAAA |
| 254 | Intron | ATGGTTTGTCTCTCGCTTGCATACCACCCAGCAGCTCACTGATGTCGACTTGTAGGTTAAA |

TABLE 21A

P. cyanescence (Pcy) vector design for PsiH2 overexpression in P. cubensis

| SEQ ID NO. | Name | Sequence |
|---|---|---|
| 165 | GPD promoter | GAGGTCCGCAAGTAGATTGAAAGTTCAGTACGTTTTTAACAATAGAGCATTTTCGAGGCTTGCGTCATTCTGTGTCAGGCTAGCAGTTTATAAGCGTTGAGGATCTAGAGCTGCTGTTCCCGCGTCTCGAATGTTCTCGGTGTTTAGGGGTTAGCAATCTGATATGATAATAATTTGTGATGACATCGATAGTACAAAAACCCCAATTCCGGTCACATCCACCATCTCCGTTTTCTCCCATCTACACACAACAAGCTCATCGCC |
| 315 | start-intron-6bp | ATGGTTTGTCTCTCGCTTGCATACCACCCAGCAGCTCACTGATGTCGACTTGTAGGTTAAAGCACCTCTC

TABLE 21A-continued

P. cyanescence (Pcy) vector design for PsiH2 overexpression in P. cubensis

| SEQ ID NO. | Name | Sequence |
|---|---|---|
|  |  | TCTCCATGGTTGATCTTTTT ACAATGGGACAGGAATATC AAACCGACATCATCTACGTC GATGCTGGAGGAACGGACAT GATTATTCTGAACTCATTGG AGGCTATAACCGACTTGTTG GAAAAGCGGGGGTCCCTGTA |
| 18 | PcyPsiH2 | CTCCGGTCGACTCGAGAGCA CGATGGTGAACGAGCTCATG GGATGGGAGTTCGATTTTGG ATTCATACCCTACGGCGAGA GATGGCGCGAAGAAAGGCGC ATGTTCGCCAAGGAGTTCAG CGAGAAAAATATAAGGCAAT TCCGCCACGCTCAAGTGAAG GCTGCCAATCAGCTTGTCCG GCAGCTGACAGACAAGCCAG ATCGTTGGTCACACCACATC CGGCATCAGATAGCGTCTAT GGCTCTGGATATTGGCTATG GGATCGATCTGGCCGAGGAT GATCCCTGGATTGCAGCATC TGAGCTAGCAAACGAAGGGC TCGCTGTTGCATCAGTGCCG GGCAGTTTCTGGGTCGACAC ATTCCCTTTCCTTAAATACC TTCCGTCCTGGCTTCCAGGT GCTGAATTCAAGCGCAATGC AAAGATGTGGAAGGAAGGCG CTGACCATATGGTGAATATG CCATATGAAACAATGAAAAA ACTGTCTGCTCAAGGTTTGA CCCGACCCTCATACGCCTCG GCTCGCCTCCAGGCTATGGA TCCTAATGGCGATCTCGAGC ACCAGGAACGTGTGATCAAG AATACGGCCACACAAGTCAA TGTCGGTGGCGGTGATACGA CTGTCGGTGCTGTGTCAGCA TTTATTTTAGCTGTATGGTCAA ATATCCCGAGGTTCAACGTA AAGTCCAAGCTGAGCTGGAT GAATTCACGAGTAAGGCCG TATCCCAGATTACGACGAAG ATAACGACTCCTTGCCGTAT CTCAGCGCATGCTTTAAGGA ACTCTTTCGATGGGGCCAGA TTGCACCCCTTGCTATTGCT CATCGACTTATCAAGGATGA TGTTTACCGCGAGTATACTA TACCTAAGAATGCTTTGGTC TTCGCTAATAATTGGTACGG ACGGACTGTACTGAACGATC CCTCTGAGTATCCAAATCCC TCTGAGTTCCGTCCAGAACG ATATCTCGGTCCTGACGGGA AGCCCGACGATACGGTTCGT GATCCCCGCAAAGCAGCATT CGGGTATGGTCGTCGCGTTT GCCCTGGAATCCACCTTGCT CAGTCGACGGTATGGATTGC AGGGGTGGCTCTTGTGTCCG CGTTCAACATCGAACTGCCT GTTGATAAGGATGGGAAATG TATTGACATACCAGCGGCGT TTACAACAGGATTTTTCAGG TAA |

TABLE 21B

P. tampanensis (Pt) vector design for PsiH2 overexpression in P. cubensis

| SEQ ID NO. | Name | Sequence |
|---|---|---|
| 165 | GPD promoter | GAGGTCCGCAAGTAGATTGA AAGTTCAGTACGTTTTTAAC AATAGAGCATTTTCGAGGCT TGCGTCATTCTGTGTCAGGC TAGCAGTTTATAAGCGTTGA GGATCTAGAGCTGCTGTTCC CGCGTCTCGAATGTTCTCGG TGTTTAGGGGTTAGCAATCT GATATGATAATAATTTGTGA TGACATCGATAGTACAAAAA CCCCAATTCCGGTCACATCC ACCATCTCCGTTTTCTCCCA TCTACACACAACAAGCTCAT CGCC |
| 254 | start-intron-6bp | ATGGTTTGTCTCTCGCTTGC ATACCACCCAGCAGCTCACT GATGTCGACTTGTAGGTTAA A |
| 19 | PtPsiH2 | CAAAACGGCGCACTCACTGT ATTTGTTGCATTTATTTCTG CAGCGTGCATATACTATGTG CACGCTCGTCGGGCTCGGCG AGCCTCGCTGCCACCAGGTC CGCGCGGAATACCCCTGCCA TTTGTGGGGAATGTATTCGA TATGCCTTCGGAGTCTTCTT GGCTCACGTTCCTGGAATGG GGAAAACAGTATCAATCTGA TTTGATCTACTTAAACTCCG GGGGAATAGAAATGGTCATT CTGAACACGTTGGAAACAAT GACCGATCTCTTGGAGAAGA GGGGATCTATATATTCAGGA CGACTAGAAAGTACAATGGT CAATGAACTCATGGGTTGGA AATTCGATTTTGGATTCGTG ACCTATGCGAGCGCtGGCG AGAAGAAAGACGCATGTTTT CGAGGGAGTTCAACGAGAAA AATATATCAAACAATTTCGTCA TGCACAAGTCAAGGCCCTCA AAGAACTCGTTCGGAAACTT GACAAAGACCCAAGTCGATG GTACCAGCATCTTCGACACC AAAATTGCATCTATGGCCTTG GATATTGGCTATGGAATTGA TCTCGCAGAAAACGACCCAT GGATTGAAGAGACCATCCTC GCAAACGATGCTCTAGCCCT TGCATCTGTCCCTGGGTGCT ATTGGGTTGACTCGTTTCCC ATTCTTCAATATGTTCCATC TTGGCTTCCCTTTGCAGGAT TCAAGCGCAAAGCAAAGGTG TGGAAGAAAAATACCGAGTA CATGGTCAACGTTCTATACG AGACCATGAAAAGACAGACA GTACAAGGGTTAACCCGTCC ATCCTATGCTTCAGCACGTT TACAGGCCATGGCTCCAGAC ATTAACCTTGAACATCAAGA ACGGGTAATTAAAAATTCAG CCTCACAGGTTATTGTTGGC GGTGGCGATACTACCGTGTC TGCATTGGCAGCATTTATTC TAGCTATGGTCAAATATCCT AATGTCCAACGCAAGGTCCA GGCGGAGCTCGACGCGATCG CGAGCCAAAACGAAATACCC GACTTTGACGAAGAAAATGG AACGATGCCATACCTCACCG CATGTCTCAAAGAAGTTTTC |

TABLE 21B-continued

P. tampanensis (Pt) vector design for
PsiH2 overexpression in P. cubensis

| SEQ ID NO. | Name | Sequence |
|---|---|---|
| | | CGCTGGAACCAGATCGCGCC<br>CCTTGGTATCGCCCACCGGC<br>TTGACAAGGACGATTCTTAC<br>CGTGGCTACCTCATACCCAA<br>GGGAACCTTGGTTTTTGCCA<br>ACATTTGGGCTATCTTGAAC<br>GATCCATTGATGTATCCTAA<br>TCCTGGCGAGTTTCAACCTG<br>AGCGATATCTCGGACCTGAC<br>GGCAAGCACGATCCCTCTGT<br>GCGCGACCCACGTAAAATTG<br>CCTTCGGCTGGGGTCGACGC<br>GCTTGTCCCGGCATATACTT<br>GGCACAATCCACCGTATGGC<br>ACACAGCAACGAACCTCCTC<br>TCTGCATTCAACATAGAGCC<br>ACCTCTTAACGAAGAGGGAA<br>AGCCTATCAAAGTCGAGGCG<br>GCTTTCACCACTGGATTTTT<br>CAGGTATAGTCCCCGCAGTG<br>ATGCATGA |

In some embodiments, PsiD gene over-expression comprises a vector expressing PsiD gene under the control of a 35S promoter (TABLE 22: SEQ ID NO: 104, 17,647 bp; FIG. 3A). In some embodiments, PsiH gene over-expression comprises a vector expressing PsiH gene under the control of a 35S promoter (TABLE 22: SEQ ID NO: 103, 18,494 bp; FIG. 3B). In some embodiments, PsiK gene over-expression comprises a vector expressing PsiK gene under the control of a 35S promoter (TABLE 22: SEQ ID NO: 102, 17,420 bp; FIG. 3C). In some embodiments, PsiM gene over-expression comprises a vector expressing PsiM gene under the control of a 35S promoter (TABLE 22: SEQ ID NO: 101, 17,267 bp; FIG. 3D). In some embodiments, PsiR gene over-expression comprises a vector expressing PsiR gene under the control of a GPD promoter (TABLE 22: SEQ ID NO: 108). In some embodiments, PsiH2 gene over-expression comprises a vector expressing PsiH2 gene under the control of a GPD PROMOTER (TABLE 22: SEQ ID NO: 109 and SEQ ID NO: 110).

In some embodiments, Psi genes over-expression comprises a vector expressing Psi genes under the control of a GcDED1 promoter (TABLE 22: SEQ ID NO: 105, 9,462 bp; FIG. 4A). In some embodiments, Psi genes over-expression comprises a vector expressing Psi genes under the control of a GPD promoter (TABLE 22: SEQ ID NO: 106, 8,067 bp; FIG. 4B).

In some embodiments, PsiD over-expression comprises a vector expressing Psi genes under the control of a GPD promoter (TABLE 22: SEQ ID NO: 107), resulting in a fungus comprising a blue phenotype.

TABLE 22

Psilocybin expression vector sequences.

| SEQ ID NO. | Name | Sequence |
|---|---|---|
| 101 | pGWB5:35S:<br>PsiMcds:stop | tgagcgtcgcaaaggcgctcggtcttgccttgctcgtcggtgatgtact<br>tcaccagctccgcgaagtcgctcttcttgatggagcgcatggggacgtgc<br>ttggcaatcacgcgcaccccccggccgttttagcggctaaaaaagtcatg<br>gctctgccctcgggcggaccacgcccatcatgaccttgccaagctcgtcc<br>tgcttctcttcgatcttcgccagcagggcgaggatcgtggcatcaccgaa<br>ccgcgccgtgcgcgggtcgtcggtgagccagagtttcagcaggccgccca<br>ggcggcccaggtcgccattgatgcgggccagctcgcggacgtgctcatag<br>tccacgacgcccgtgattttgtagccctggccgacggccagcaggtaggc<br>cgacaggctcatgccggccgccgccgccttttcctcaatcgctcttcgtt<br>cgtctggaaggcagtacaccttgataggtgggctgcccttcctggttggc<br>ttggtttcatcagccatccgcttgccctcatctgttacgccggcggtagc<br>cggccagcctcgcagagcaggattcccgttgagcaccgccaggtgcgaat<br>aagggacagtgaagaaggaacacccgctcgcgggggggcctacttcaccta<br>tcctgcccggctgacgccgttggatacaccaaggaaagtctacacgaacc<br>ctttggcaaaatcctgtatatcgtgcgaaaaaggatggatataccgaaaa<br>aatcgctataatgacccccgaagcagggttatgcagcggaaaagcgccacg<br>cttcccgaagggagaaaggcggacaggtatccggtaagcggcagggtcgg<br>aacaggagagcgcacgagggagcttccagggggaaacgcctggtatcttt<br>atagtcctgtcgggtttcgccacctctgacttgagcgtcgattttgtga<br>tgctcgtcagggggggcggagcctatggaaaaacgccagcaacgcggcctt<br>tttacggttcctggccttttgctggccttttgctcacatgttctttcctg<br>cgttatcccctgattctgtggataaccgtattaccgcctttgagtgagct<br>gataccgctcgccgcagccgaacgaccgagcgcagcgagtcagtgagcga<br>ggaagcggaagagcgcccagaaggccgccagagaggccgagcgcggccgtg<br>aggcttggacgctagggcagggcatgaaaaagcccgtagcgggctgctac<br>gggcgtctgacgcggtggaaaggggggaggggatgttgtctacatggctct<br>gctgtagtgagtgggttgcgctccggcagcggtcctgatcaatcgtcacc<br>ctttctcggtccttcaacgttcctgacaacgagcctccttttcgccaatc<br>catcgacaatcaccgcgagtccctgctcgaacgctgcgtccggaccggct<br>tcgtcgaaggcgtctatcgcggcccgcaacagcggcgagagcggagcctg<br>ttcaacggtgccgccgcgctcgccggcatcgctgtcgccggcctgctcct<br>caagcacggcccaacagtgaagtagctgattgtcatcagcgcattgacg<br>gcgtccccggccgaaaaacccgcctcgcagaggaagcgaagctgcgcgtc<br>ggccgtttccatctgcggtgcgcccggtcgcgtgccggcatggatgcgcg<br>cgccatcgcggtaggcgagcagcgcctgcctgaagctgcgggcattcccg<br>atcagaaatgagcgccagtcgtcgtcggctctcggcaccgaatgcgtatg<br>attctccgccagcatggcttcggccagtgcgtcgagcagcgcccgcttgt<br>tcctgaagtgccagtaaagcgccggctgctgaaccccccaaccgttccgcc |

TABLE 22-continued

Psilocybin expression vector sequences.

| SEQ ID NO. | Name | Sequence |
|---|---|---|
| | | agtttgcgtgtcgtcagaccgtctacgccgacctcgttcaacaggtccag
ggcggcacggatcactgtattcggctgcaactttgtcatgcttgacactt
tatcactgataaacataatgtgtccaccaacttatcagtgataaagaatc
cgcgcgttcaatcggaccagcggaggctggtccggaggccagacgtgaaa
cccaacataccctgatcgtaattctgagcactgtcgcgctcgacgctgt
cggcatcggcctgattatgccggtgctgccgggcctcctgcgcgatctgg
ttcactcgaacgacgtcaccgcccactatggcattctgctggcgctgtat
gcgttggtgcaatttgcctgcgcacctgtgctgggcgcgctgtcggatcg
tttcgggcggcggccaatcttgctcgtctcgctggccggcgccagatctg
gggaaccctgtggttggcatgcacatacaaatggacgaacggataaacct
tttcacgcccttttaaatatccgattattctaataaaacgctcttttctct
taggtttacccgccaatatatcctgtcaaacactgatagtttaaactgaa
ggcgggaaacgacaatctgatcatgagcggagaattaagggagtcacgtt
atgaccccgccgatgacgcgggacaagccgttttacgtttggaactgac
agaaccgcaacgttgaaggagccactcagccgcgggtttctggagtttaa
tgagctaagcacatacgtcagaaaccattattgcgcgttcaaaagtcgcc
taaggtcactatcagctagcaaatatttcttgtcaaaaatgctccactga
cgttccataaattcccctcggtatccaattagagtctcatattcactctc
aatccaaataatctgcaccggatctggatcgtttcgcatgattgaacaag
atggattgcacgcaggttctccggccgcttgggtggagaggctattcggc
tatgactgggcacaacagacaatcggctgctctgatgccgccgtgttccg
gctgtcagcgcaggggcgcccggttcttttttgtcaagaccgacctgtccg
gtgccctgaatgaactgcaggacgaggcagcgcggctatcgtggctggcc
acgacgggcgttccttgcgcagctgtgctcgacgttgtcactgaagcggg
aagggactggctgctattgggcgaagtgccggggcaggatctcctgtcat
ctcaccttgctcctgccgagaaagtatccatcatggctgatgcaatgcgg
cggctgcatacgcttgatccggctacctgcccattcgaccaccaagcgaa
acatcgcatcgagcgagcacgtactcggatggaagccggtcttgtcgatc
aggatgatctgacgaagagcatcaggggctcgcgccagccgaactgttc
gccaggctcaaggcgcgcatgcccgacggcgatgatctcgtcgtgaccca
tggcgatgcctgcttgccgaatatcatggtggaaaatggccgcttttctg
gattcatcgactgtggccggctgggtgtggcggaccgctatcaggacata
gcgttggctacccgtgatattgctgaagagcttggcggcgaatgggctga
ccgcttcctcgtgctttacggtatcgccgctcccgattcgcagcgcatcg
ccttctatcgccttcttgacgagttcttctgagcgggactctggggttcg
aaatgaccgaccaagcgacgcccaacctgccatcacgagatttcgattcc
accgccgccttctatgaaaggttgggcttcggaatcgttttccgggacgc
cggctggatgatcctccagcgcggggatctcatgctggagttcttcgccc
acgggatctctgcggaacaggcggtcgaaggtgccgatatcattacgaca
gcaacgccgacaagcacaacgccacgatcctgagcgacaatatgatcgg
gcccggcgtccacatcaacggcgtcggcggcgactgcccaggcaagaccg
agatgcaccgcgatatcttgctgcgttcggatattttcgtggagttcccg
ccacagaccggatgatccccgatcgttcaaacatttggcaataaagttt
cttaagattgaatcctgttgccggtcttgcgatgattatcatataatttc
tgttgaattacgttaagcatgtaataattaacatgtaatgcatgacgtta
tttatgagatgggtttttatgattagagtcccgcaattatacatttaata
cgcgatagaaaacaaaatatagcgcgcaaactaggataaattatcgcgcg
cggtgtcatctatgttactagatcgggcctcctgtcaatgctggcggcgg
ctctggtggttggttctggtggcggctctgagggtggtggctctgagggtg
gcggttctgagggtggcggctctgagggaggcggttccggtggtggctct
ggttccggtgattttgattatgaaaagatggcaaacgctaataagggggc
tatgaccgaaaatgccgatgaaaacgcgctacagtctgacgctaaaggca
aacttgattctgtcgctactgattacggtgctgctatcgatggtttcatt
ggtgacgtttccggccttgctaatggtaatggtgctactggtgattttgc
tggctctaattcccaaatggctcaagtcggtgacggtgataattcacctt
taatgaataatttccgtcaatatttaccttccctccctcaatcggttgaa
tgtcgcccttttgtctttggcccaatacgcaaaccgcctctccccgcgcg
ttggccgattcattaatgcagctggcacgacaggtttcccgactggaaag
cgggcagtgagcgcaacgcaattaatgtgagttagctcactcattaggca
ccccaggctttacactttatgcttccggctcgtatgttgtgtggaattgt
gagcggataacaatttcacacaggaaacagctatgaccatgattacgcca
agcttgcatgcctgcaggtccccagattagccttttcaatttcagaaaga
atgctaacccacagatggttagagaggcttacgcagcaggtctcatcaag
acgatctacccgagcaataatctccaggaaatcaaataccttcccaagaa
ggttaaagatgcagtcaaaagattcaggactaactgcatcaagaacacag
agaaagatatatttctcaagatcagaagtactattccagtatggacgatt
caaggcttgcttcacaaaccaaggcaagtaatagagattggagtctctaa
aaaggtagttcccactgaatcaaaggccatggagtcaaagattcaaatag
aggacctaacagaactcgccgtaaagactggcgaacagttcatacagagt
ctcttacgactcaatgacaagaagaaaatcttcgtcaacatgtggagca
cgacacacttgtctactccaaaaatatcaaagatacagtctcagaagacc
aaagggcaattgagacttttcaacaaagggtaatatccggaaacctcctc
ggattccattgcccagctatctgtcactttattgtgaagatagtggaaaa
ggaaggtggctcctacaaatgccatcattgcgataaaggaaaggccatcg |

TABLE 22-continued

Psilocybin expression vector sequences.

| SEQ ID NO. | Name | Sequence |
|---|---|---|
| | | ttgaagatgcctctgccgacagtggtcccaaagatggaccccacccacg |
| | | aggagcatcgtggaaaagaagacgttccaaccacgtcttcaaagcaagt |
| | | ggattgatgtgatatctccactgacgtaagggatgacgcacaatcccact |
| | | atccttcgcaagacccttcctctatataaggaagttcatttcatttggag |
| | | agaacacgggggactctaatcaaacaagtttgtacaaaaaagctgaacga |
| | | gaaacgtaaaatgatataaatatcaaatgcatatcagaaatccttaccgt |
| | | acaccaattgactatcaagcactttcagaggccttccctcccctcaagcc |
| | | atttgtgtctgtcaatgcagatggtaccagttctgttgacctcactatcc |
| | | cagaagcccagagggcgttcacggccgctcttcttcatcgtgacttcggg |
| | | ctcaccatgaccataccagaagaccgtctgtgcccaacagtccccaatag |
| | | gttgaactacgttctgtggattgaagatattttcaactacacgaacaaaa |
| | | ccctcggcctgtcggatgaccgtcctattaaaggcgttgatattggtaca |
| | | ggagcctccgcaatttatcctatgcttgcctgtgctcggttcaaggcatg |
| | | gtctatggttggaacagaggtcgagaggaagtgcattgacacggcccgcc |
| | | tcaatgtcgtcgcgaacaatctccaagaccgtctctcgatattagagaca |
| | | tccattgatggtcctattctcgtcccattttcgaggcgactgaagaata |
| | | cgaatacgagtttactatgtgtaaccctccattctacgacggtgctgccg |
| | | atatgcagacttcggatgctgccaaaggatttggatttggcgtgggcgct |
| | | ccccattctggaacagtcatcgaaatgtcgactgagggaggtgaatcggc |
| | | tttcgtcgctcagatggtccgtgagagcttgaagcttcgaacacgatgca |
| | | gatggtacacgagtaacttgggaaagctgaaatccttgaaagaaatagtg |
| | | gggctgctgaaagaacttgagataagcaactatgccattaacgaatacgt |
| | | tcaggggtccacacgtcgttatgccgttgcgtggtctttcactgatattc |
| | | aactgcctgaggagctttctcgtccctctaaccccgagctcagctctctt |
| | | ttctagcattttacgtttctcgttcagctttcttgtacaaagtggttcga |
| | | tctagaggatccatggtgagcaagggcgaggagctgttcaccgggggtggt |
| | | gcccatcctggtcgagctggacggcgacgtgaacggccacaagttcagcg |
| | | tgtccggcgagggcgagggcgatgccacctacggcaagctgaccctgaag |
| | | ttcatctgcaccaccggcaagctgcccgtgccctggcccacccctcgtgac |
| | | caccttcacctacggcgtgcagtgcttcagccgctaccccgaccacatga |
| | | agcagcacgacttcttcaagtccgccatgcccgaaggctacgtccaggag |
| | | cgcaccatcttcttcaaggacgacggcaactacaagacccgcgccgaggt |
| | | gaagttcgagggcgacaccctggtgaaccgcatcgagctgaagggcatcg |
| | | acttcaaggaggacggcaacatcctggggcacaagctggagtacaactac |
| | | aacagccacaacgtctatatcatggccgacaagcagaagaacggcatcaa |
| | | ggtgaacttcaagatccgccacaacatcgaggacggcagcgtgcagctcg |
| | | ccgaccactaccagcagaacacccccatcggcgacggccccgtgctgctg |
| | | cccgacaaccactacctgagcacccagtccgccctgagcaaagaccccaa |
| | | cgagaagcgcgatcacatggtcctgctggagttcgtgaccgccgccggga |
| | | tcactcacggcatggacgagctgtacaagtaaagcggcccgagctcgaat |
| | | ttccccgatcgttcaaacatttggcaataaagtttcttaagattgaatcc |
| | | tgttgccggtcttgcgatgattatcatataatttctgttgaattacgtta |
| | | agcatgtaataattaacatgtaatgcatgacgttatttatgagatgggtt |
| | | tttatgattagagtcccgcaattatacatttaatacgcgatagaaaacaa |
| | | aatatagcgcgcaaactaggataaattatcgcgcgcggtgtcatctatgt |
| | | tactagatcgggaattagcttcatcaacgcaagacatgcgcacgaccgtc |
| | | tgacaggagaggaatttccgacgagcacagaaaggacttgctcttggacg |
| | | taggcctatttctcaggcacatgtatcaagtgttcggacgtgggttttcg |
| | | atggtgtatcagccgccgccaactgggagatgaggaggcttctttgggg |
| | | gcagtcagcagttcatttcacaagacagaggaacttgtaaggagatgcac |
| | | tgatttatcttggcgcaaaccagcaggacgaattagtgggaatagcccgc |
| | | gaatatctaagttatgcctgtcggcatgagcagaaacttccaattcgaaa |
| | | cagtttggagaggttgttttttgggcataccttttgttagtcagcctctcg |
| | | attgctcatcgtcattacacagtaccgaagtttgatcgatctagtaacat |
| | | agatgacaccgcgcgcgataattatcctagtttgcgcgctatattttgt |
| | | tttctatcgcgtattaaatgtataattgcgggactctaatcataaaaacc |
| | | catctcataaataacgtcatgcattacatgttaattattacatgcttaac |
| | | gtaattcaacagaaattatatgataatcatcgcaagaccggcaacaggat |
| | | tcaatcttaagaaacttttattgccaaatgtttgaacgatctgcttcgacg |
| | | cactccttctttactccaccatctcgtccttattgaaaacgtgggtagca |
| | | ccaaaacgaatcaagtcgctggaactgaagttaccaatcacgctggatga |
| | | tttgccagttggattaatcttgccttccccgcatgaataatattgatga |
| | | atgcatgcgtgaggggtatttcgattttggcaatagctgcaattgccgcg |
| | | acatcctccaacgagcataattcttcagaaaaatagcgatgttccatgtt |
| | | gtcagggcatgcatgatgcacgttatgaggtgacggtgctaggcagtatt |
| | | ccctcaaagtttcatagtcagtatcatattcatcattgcattcctgcaag |
| | | agagaattgagacgcaatccacacgctgcggcaacctccggcgttcgtg |
| | | gtctatttgctcttggacgttgcaaacgtaagtgttggatcccggtcggc |
| | | atctactctattcctttgccctcggacgagtgctggggcgtcggtttcca |
| | | ctatcggcgagtacttctacacagccatcggtccagacggccgcgcttct |
| | | gcgggcgatttgtacgcccgacagtcccggctccggatcggacgattg |
| | | cgtcgcatcgaccctgcgcccaagctgcatcatcgaaattgccgtcaacc |
| | | aagctctgatagagttggtcaagaccaatgcggagcatatacgcccggag |
| | | ccgcggcgatcctgcaagctccggatgcctccgctcgaagtagcgcgtct |

TABLE 22-continued

Psilocybin expression vector sequences.

| SEQ ID NO. | Name | Sequence |
|---|---|---|
| | | gctgctccatacaagccaaccacggcctccagaagaagatgttggcgacc tcgtattgggaatccccgaacatcgcctcgctccagtcaatgaccgctgt tatgcggccattgtccgtcaggacattgttggagccgaaatccgcgtgca cgaggtgccggacttcggggcagtcctcggcccaaagcatcagctcatcg agagcctgcgcgacggacgcactgacggtgtcgtccatcacagtttgcca gtgatacacatggggatcagcaatcgcgcatatgaaatcacgccatgtag tgtattgaccgattccttgcggtccgaatgggccgaacccgctcgtctgg ctaagatcggccgcagcgatcgcatccatggcctccgcgaccggctgcag aacagcgggcagttcggtttcaggcaggtcttgcaacgtgacaccctgtg cacggcgggagatgcaataggtcaggctctcgctgaattccccaatgtca agcacttccggaatcgggagcgcggccgatgcaaagtgccgataaacata acgatctttgtagaaaccatcggcgcagctatttacccgcaggacatatc cacgccctcctacatcgaagctgaaagcacgagattcttcgccctccgag agctgcatcaggtcggagacgctgtcgaacttttcgatcagaaacttctc gacagacgtcgcggtgagttcaggcttttttcatatcggggtcgtcctctc caaatgaaatgaacttccttatatagaggaagggtcttgcgaaggatagt gggattgtgcgtcatcccttacgtcagtggagatatcacatcaatccact tgctttgaagacgtggttggaacgtcttcttttttccacgatgctcctcgt ggggggggtccatctttgggaccactgtcggcagaggcatcttgaacgat agccttttcctttatcgcaatgatggcatttgtaggtgccaccttccttt ctactgtccttttgatgaagtgacagatagctgggcaatggaatccgagg aggtttcccgatattacccttgttgaaaagtctcaatagcccttggtc ttctgagactgtatctttgatattcttggagtagacgagagtgtcgtgct ccaccatgttgacggatctctaggacgcgtcctagaagctaattcactgg ccgtcgttttacaacgtcgtgactgggaaaaccctggcgttacccaactt aatcgccttgcagcacatccccctttcgccagctggcgtaatagcgaaga ggcccgcaccgatcgcccttcccaacagttgcgcagcctgaatggcgccc gctccttcgctttcttccctt ccttttctcgccacgttcgccggctttcc ccgtcaagctctaaatcggggctcccttttagggttccgatttagtgctt tacggcacctcgaccccaaaaaacttgatttgggtgatggttcacgtagt gggccatcgccctgatagacggttttttcgcccttttgacgttggagtccac gttctttaatagtggactcttgttccaaactggaacaacactcaaccct tctcgggctattcttttgatttataagggattttgccgatttcggaacca ccatcaaacaggattttcgcctgctggggcaaaccagcgtggaccgcttg ctgcaactctctcagggccaggcggtgaagggcaatcagctgttgcccgt ctcactggtgaaaagaaaaaccaccccagtacattaaaaacgtccgcaat gtgttattaagttgtctaagcgtcaatttgtttacaccacaatatatcct gccaccagccagccaacagctccccgaccggcagctcggcacaaaatcac cactcgatacaggcagcccatcagtccgggacggcgtcagcgggagagcc gttgtaaggcggcagactttgctcatgttaccgatgctattcggaagaac ggcaactaagctgccgggtttgaaacacggatgatctcgcggagggtagc atgttgattgtaacgatgacagagcgttgctgcctgtgatcaaatatcat ctccctcgcagagatccgaattatcagccttcttattcatttctcgctta accgtgacaggctgtcgatcttgagaactatgccgacataataggaaatc gctggataaagccgctgaggaagctgagtggcgctatttctttagaagtg aacgttgacgatatcaactcccctatccattgctcaccgaatggtacagg tcggggacccgaagttccgactgtcggcctgatgcatccccggctgatcg accccagatctggggctgagaaagcccagtaaggaaacaactgtaggttc gagtcgcgagatcccccggaaccaaaggaagtaggttaaaccccgctccga tcaggccgagccacgccaggccgagaacattggttcctgtaggcatcggg attggcggatcaaacactaaagctactggaacgagcagaagtcctccggc cgccagttgccaggcggtaaaggtgagcagaggcacgggaggttgccact tgcgggtcagcacggttccgaacgccatggaaaccgcccccgccaggccc gctgcgacgccgacaggatctagcgctgcgtttggtgtcaacaccaacag cgccacgcccgcagttccgcaaatagcccccaggaccgccatcaatcgta tcgggctacctagcagagcggcagagatgaacacgaccatcagcggctgc acagcgcctaccgtcgccgcgaccccgcccggcaggcggtagaccgaaat aaacaacaagctccagaatagcgaaatattaagtgcgccgaggatgaaga tgcgcatccaccagattcccgttggaatctgtcggacgatcatcacgagc aataaacccgccggcaacgcccgcagcagcataccggcgaccctcggcc tcgctgttcgggctccacgaaaacgccggacagatgcgccttgtgagcgt ccttggggccgtcctcctgtttgaagaccgacagcccaatgatctcgccg tcgatgtaggcgccgaatgccacggcatctcgcaaccgttcagcgaacgc ctccatgggcttttctcctcgtgctcgtaaacggacccgaacatctctg gagctttcttcagggccgacaatcggatctcgcggaaatcctgcacgtcg gccgctccaagccgtcgaatctgagccttaatcacaattgtcaattttaa tcctctgtttatcggcagttcgtagagcgcgccgtgcgtcccgagcgata ctgagcgaagcaagtgcgtcgagcagtgcccgcttgttcctgaaatgcca gtaaagcgctggctgctgaaccccagccggaactgacccccacaaggccc tagcgtttgcaatgcaccaggtcatcattgacccaggcgtgttccaccag gccgctgcctcgcaactcttcgcaggcttcgccgacctgctcgcgccact tcttcacgcgggtggaatccgatccgcacatgaggcggaaggtttccagc ttgagcgggtacggctcccggtgcgagctgaaatagtcgaacatccgtcg ggccgtcggcgacagcttgcggtacttctcccatatgaatttcgtgtagt |

TABLE 22-continued

Psilocybin expression vector sequences.

| SEQ ID NO. | Name | Sequence |
|---|---|---|
| | | ggtcgccagcaaacagcacgacgatttcctcgtcgatcaggacctggcaa
cgggacgttttcttgccacggtccaggacgcggaagcggtgcagcagcga
caccgattccaggtgcccaacgcggtcggacgtgaagcccatcgccgtcg
cctgtaggcgcgacaggcattcctcggccttcgtgtaataccggccattg
atcgaccagcccaggtcctggcaaagctcgtagaacgtgaaggtgatcgg
ctcgccgataggggtgcgcttcgcgtactccaacacctgctgccacacca
gttcgtcatcgtcggcccgcagctcgacgccggtgtaggtgatcttcacg
tccttgttgacgtggaaaatgaccttgttttgcagcgcctcgcgcgggat
tttcttgttgcgcgtggtgaacagggcagagcgggccgtgtcgtttggca
tcgctcgcatcgtgtccggccacggcgcaatatcgaacaaggaaagctgc
atttccttgatctgctgcttcgtgtgtttcagcaacgcggcctgcttggc
ctcgctgacctgttttgccaggtcctcgccggcggttttcgcttcttgg
tcgtcatagttcctcgcgtgtcgatggtcatcgacttcgccaaacctgcc
gcctcctgttcgagacgacgcgaacgctccacggcggccgatggcgcggg
cagggcaggggagccagttgcacgctgtcgcgctcgatcttggccgtag
cttgctggaccatcgagccgacggactggaaggtttcgcggggcgcacgc
atgacggtgcggcttgcgatggtttcggcatcctcggcggaaaaccccgc
gtcgatcagttcttgcctgtatgccttccggtcaaacgtccgattcattc
accctccttgcgggattgccccgactcacgccggggcaatgtgcccttat
tcctgatttgacccgcctggtgccttggtgtccagataatccaccttatc
ggcaatgaagtcggtcccgtagaccgtctggccgtccttctcgtacttgg
tattccgaatcttgccctgcacgaataccagcgaccccttgcccaaatac
ttgccgtgggcctcggcctgagagccaaaacacttgatgcggaagaagtc
ggtgcgctcctgcttgtcgccggcatcgttgcgccacatctaggtactaa
aacaattcatccagtaaaatataatatttatttctcccaatcaggctt
gatccccagtaagtcaaaaaatagctcgacatactgttcttcccgatat
cctccctgatcgaccggacgcagaaggcaatgtcataccacttgtccgcc
ctgccgcttctcccaagatcaataaagccacttactttgccatcttcac
aaagatgttgctgtctcccaggtcgccgtgggaaaagacaagttcctctt
cgggcttttccgtctttaaaaaatcatacagctcgcgcggatctttaaat
ggagtgtcttcttcccagttttcgcaatccacatcggccagatcgttatt
cagtaagtaatccaattcggctaagcggctgtctaagctattcgtataag
gacaatccgatatgtcgatggagtgaaagagcctgatgcactccgcatac
agctcgataatcttttcagggctttgttcatcttcatactcttccgagca
aaggacgccatcggcctcactcatgagcagattgctccagccatcatgcc
gttcaaagtgcaggacctttggaacaggcagctttccttccagccatagc
atcatgtcctttcccgttccacatcataggtggtcccttttataccggct
gtccgtcatttttaaatataggttttcattttctcccaccagcttatata
ccttagcaggagacattccttccgtatctttacgcagcggtattttcg
atcagttttttcaattccggtgatattctcatttagccatttattattt
ccttcctcttttctacagtatttaaagataccccaagaagctaattataa
caagacgaactccaattcactgttccttgcattctaaaaccttaaatacc
agaaaacagcttttttcaaagttgttttcaaagttggcgtataacatagta
tcgacggagccgattttgaaaccacaattatgggtgatgctgccaactta
ctgatttagtgtatgatggtgtttttgaggtgctccagtggcttctgtgt
ctatcagctgtccctcctgttcagctactgacggggtggtgcgtaacggc
aaaagcaccgccggacatcagcgctatctctgctctcactgccgtaaaac
atggcaactgcagttcacttacaccgcttctcaacccggtacgcaccaga
aaatcattgatatggccatgaatggcgttggatgccgggcaacagcccgc
attatgggcgttggcctcaacacgattttacgtcacttaaaaaactcagg
ccgcagtcggtaacctcgcgcatacagccgggcagtgacgtcatcgtctg
cgcggaaatggacgaacagtggggctatgtcggggctaaatcgcgccagc
gctggctgttttacgcgtatgacagtctccggaagacggttgttgcgcac
gtattcggtgaacgcactatggcgacgctggggcgtcttatgagcctgct
gtcacccttttgacgtggtgatatggatgacggatggctggccgctgtatg
aatcccgcctgaagggaaagctgcacgtaatcagcaagcgatatacgcag
cgaattgagcggcataacctgaatctgaggcagcacctggcacggctggg
acggaagtcgctgtcgttctcaaaatcggtggagctgcatgacaaagtca
tcgggcattatctgaacataaaacactatcaataagttggagtcattacc
caattatgatagaatttacaagctataaggttattgtcctgggtttcaag
cattagtccatgcaagttttttatgctttgcccattctatagatatattga
taagcgcgctgcctatgccttgcccctgaaatccttacatacggcgata
tcttctatataaaagatatattatcttatcagtattgtcaatatattcaa
ggcaatctgcctcctcatcctcttcatcctcttcgtcttggtagcttttt
aaatatggcgcttcatagagtaattctgtaaaggtccaattctcgttttc
atacctcggtataatcttacctatcacctcaaatggttcgctgggtttat
cgcaccccgaacacgagcacggcacccgcgaccactatgccaagaatgc
ccaaggtaaaaattgccggccccgccatgaagtccgtgaatgccccgacg
gccgaagtgaagggcaggccgccacccaggccgcgccctcactgcccgg
cacctggtcgctgaatgtcgatgccagcacctgcggcacgtcaatgcttc
cgggcgtcgcgctcgggctgatcgccatcccgttactgccccgatcccg
gcaatggcaaggactgccagcgctgccattttggggtgaggccgttcgc
ggccgaggggcgcagcccctgggggatgggaggcccgcgttagcgggcc
gggagggttcgagaaggggggcacccccccttcggcgtgcgcggtcacgc |

TABLE 22-continued

Psilocybin expression vector sequences.

| SEQ ID NO. | Name | Sequence |
|---|---|---|
| | | gcacagggcgcagccctggttaaaaacaaggtttataaatattggtttaa aagcaggttaaaagacaggttagcggtggccgaaaaacgggcggaaaccc ttgcaaatgctggattttctgcctgtggacagcccctcaaatgtcaatag gtgcgcccctcatctgtcagcactctgcccctcaagtgtcaaggatcgcg cccctcatctgtcagtagtcgcgcccctcaagtgtcaataccgcagggca cttatccccaggcttgtccacatcatctgtgggaaactcgcgtaaaatca ggcgttttcgccgatttgcgaggctggccagctccacgtcgccggccgaa atcgagcctgcccctcatctgtcaacgccgcgccgggtgagtcggcccct caagtgtcaacgtccgcccctcatctgtcagtgagggccaagttttccgc gaggtatccacaacgccggcggccgcggtgtctcgcacacggcttcgacg gcgtttctggcgcgtttgcagggccatagacggccgccagcccagcggcg agggcaaccagcccgg |
| 102 | pGWB5:35S: PsiKcds:stop | tgagcgtcgcaaaggcgctcggtcttgccttgctcgtcggtgatgtactt caccagctccgcgaagtcgctcttcttgatggagcgcatggggacgtgct tggcaatcacgcgcaccccccggccgttttagcggctaaaaaagtcatgg ctctgccctcgggcggaccacgcccatcatgaccttgccaagctcgtcct gcttctcttcgatcttcgccagcagggcgaggatcgtggcatcaccgaac cgcgccgtcgcgggtcgtcggtgagccagagtttcagcaggccgcccag gcgggcccaggtcgccattgatgcgggccagctcgcggacgtgctcatagt ccacgacgcccgtgattttgtagccctggccgacggccagcaggtaggcc gacaggctcatgccggccgccgccgccttttcctcaatcgctcttcgttc gtctggaaggcagtacaccttgataggtgggctgcccttcctggttggct tggtttcatcagccatccgcttgccctcatctgttacgccggcggtagcc ggccagcctcgcagagcaggattcccgttgagcaccgccaggtgcgaata agggacagtgaagaaggaacacccgctcgcgggggggcctacttcacctat cctgcccggctgacgccgttggatacaccaaggaaagtctacacgaaccc tttggcaaaatcctgtatatcgtgcgaaaaaggatggatataccgaaaaa atcgctataatgaccccgaagcagggttatgcagcggaaaagcgccacgc ttcccgaagggagaaaggcggacaggtatccggtaagcggcagggtcgga acaggagagcgcacgagggagcttccaggggaaacgcctggtatctttta tagtcctgtcgggtttcgccacctctgacttgagcgtcgatttttgtgat gctcgtcagggggcggagcctatggaaaaacgccagcaacgcggccttt ttacggttcctggccttttgctggccttttgctcacatgttctttcctgc gttatcccctgattctgtggataaccgtattaccgcctttgagtgagctg ataccgctcgccgcagccgaacgaccgagcgcagcgagtcagtgagcgag gaagcggaagagcgccagaaggccgccagagaggccgagcgcggccgtga ggcttggacgctagggcagggcatgaaaaagcccgtagcgggctgctacg ggcgtctgacgcggtggaaaggggagggatgttgtctacatggctctg ctgtagtgagtgggttgcgctccggcagcggtcctgatcaatcgtccaccc tttctggtccttcaacgttcctgacaacgagcctcctttttcgccaatcc atcgacaatcaccgcgagtccctgctcgaacgctgcgtccggaccggctt cgtcgaaggcgtctatcgcggcccgcaacagcggcgagagcggagcctgt tcaacggtgccgccgcgctcgccggcatcgctgtcgcggcctgctcctc aagcacggccccaacagtgaagtagctgattgtcatcagcgcattgacgg cgtccccggccgaaaaacccgcctcgcagaggaagcgaagctgcgcgtcg gccgtttccatctgcggtgcgcccggtcgcgtgccggcatggatgcgcgc gccatcgcggtaggcgagcagcgcctgcctgaagctgcgggcattcccga tcagaaatgagcgccagtcgtcgtcggctctcggcaccgaatgcgtatga ttctccgccagcatggcttcggccagtgcgtcgagcagcgcccgcttgtt cctgaagtgccagtaaagcgccggctgctgaaccccaaccgttccgcca gtttgcgtgtcgtcagaccgtctacgccgacctcgttcaacaggtccagg gcggcacggatcactgtattcggctgcaactttgtcatgcttgacacttt atcactgataaacataatatgtccaccaacttatcagtgataaagaatcc gcgcgttcaatcggaccagcggaggctggtccggaggccagacgtgaaac ccaacataccctgatcgtaattctgagcactgtcgcgctcgacgctgtc ggcatcggcctgattatgccggtgctgccgggcctcctgcgcgatctggt tcactcgaacgacgtcaccgcccactatggcattctgctggcgctgtatg cgttggtgcaatttgcctgcgcacctgtgctgggcgcgctgtcggatcgt ttcggggcggccaatcttgctcgtctcgctggccggcgccagatctggg gaaccctgtggttggcatgcacatacaaatggacgaacggataaacctt tcacgccctttttaaatatccgattattctaataaacgctcttttctctta ggtttacccgccaatatatcctgtcaaacactgatagtttaaactgaagg gggaaacgacaatctgatcatgagcggagaattaagggagtcacgttatg accccgccgatgacgcgggacaagccgttttacgtttggaactgacaga accgcaacgttgaaggagccactcagccgcgggtttctggagtttaatga gctaagcacatacgtcagaaaccattattgcgcgttcaaaagtcgcctaa ggtcactatcagctagcaaatatttcttgtcaaaaatgctccactgacgt tccataaattccctcggtatccaattagagtctcatattcactctcaat ccaaataatctgcaccggatctggatcgtttcgcatgattgaacaagatg gattgcacgcaggttctccggccgcttgggtggagaggctattcggctat gactgggcacaacagacaatcggctgctctgatgccgccgtgttccggct gtcagcgcagggcgcccggttcttttttgtcaagaccgacctgtccggtg ccctgaatgaactgcaggacgaggcagcgcggctatcgtggctggccacg |

TABLE 22-continued

Psilocybin expression vector sequences.

| SEQ ID NO. | Name | Sequence |
|---|---|---|
| | | acgggcgttccttgcgcagctgtgctcgacgttgtcactgaagcgggaag
ggactggctgctattgggcgaagtgccggggcaggatctcctgtcatctc
accttgctcctgccgagaaagtatccatcatggctgatgcaatgcggcgg
ctgcatacgcttgatccggctacctgcccattcgaccaccaagcgaaaca
tcgcatcgagcgagcacgtactcggatggaagccggtcttgtcgatcagg
atgatctggacgaagagcatcaggggctcgcgccagccgaactgttcgcc
aggctcaaggcgcgcatgcccgacggcgatgatctcgtcgtgacccatgg
cgatgcctgcttgccgaatatcatggtggaaaatggccgcttttctggat
tcatcgactgtggccggctgggtgtggcggaccgctatcaggacatagcg
ttggctacccgtgatattgctgaagagcttggcggcgaatgggctgaccg
cttcctcgtgctttacggtatcgccgctcccgattcgcagcgcatcgcct
tctatcgccttcttgacgagttcttctgagcgggactctgggggttcgaaa
tgaccgaccaagcgacgcccaacctgccatcacgagatttcgattccacc
gccgccttctatgaaaggttgggcttcggaatcgtttccgggacgccgg
ctggatgatcctccagcgcggggatctcatgctggagttcttcgcccacg
ggatctctgcggaacaggcggtcgaaggtgccgatatcattacgacagca
acggccgacaagcacaacgccacgatcctgagcgacaatatgatcgggcc
cggcgtccacatcaacggcgtcggcggcgactgcccaggcaagaccgaga
tgcaccgcgatatcttgctgcgttcggatattttcgtggagttcccgcca
cagacccggatgatccccgatcgttcaaacatttggcaataaagtttctt
aagattgaatcctgttgccggtcttgcgatgattatcatataatttctgt
tgaattacgttaagcatgtaataattaacatgtaatgcatgacgttattt
atgagatgggtttttatgattagagtcccgcaattatacatttaatacgc
gatagaaaacaaaatatagcgcgcaaactaggataaattatcgcgcgcgg
tgtcatctatgttactagatcgggcctcctgtcaatgctggcggcggctc
tggtggtggttctggtggcggctctgagggtggtggctctgagggtggcg
gttctgagggtggcggctctgagggaggcggttccggtggtggctctggt
tccggtgattttgattatgaaaagatggcaaacgctaataaggggggctat
gaccgaaaatgccgatgaaaacgcgctacagtctgacgctaaaggcaaac
ttgattctgtcgctactgattacggtgctgctatcgatggtttcattggt
gacgtttccggccttgctaatggtaatggtgctactggtgattttgctgg
ctctaattcccaaatggctcaagtcggtgacggtgataattcacctttaa
tgaataatttccgtcaatatttaccttccctccctcaatcggttgaatgt
cgcccttttgtctttggcccaatacgcaaaccgcctctccccgcgcgttg
gccgattcattaatgcagctggcacgacaggtttcccgactggaaagcgg
gcagtgagcgcaacgcaattaatgtgagttagctcactcattaggcaccc
caggctttacactttatgcttccggctcgtatgttgtgtggaattgtgag
cggataacaatttcacacaggaaacagctatgaccatgattacgccaagc
ttgcatgcctgcaggtccccagattagccttttcaatttcagaaagaatg
ctaacccacagatggttagagaggcttacgcagcaggtctcatcaagacg
atctacccgagcaataatctccaggaaatcaaataccttcccaagaaggt
taaagatgcagtcaaaagattcaggactaactgcatcaagaacacagaga
aagatatatttctcaagatcagaagtactattccagtatggacgattcaa
ggcttgcttcacaaaccaaggcaagtaatagagattggagtctctaaaaa
ggtagttcccactgaatcaaaggccatggagtcaaagattcaaatagagg
acctaacagaactcgccgtaaagactggcgaacagttcatacagagtctc
ttacgactcaatgacaagaagaaaatcttcgtcaacatggtggagcacga
cacacttgtctactccaaaaatatcaaagatacagtctcagaagaccaaa
gggcaattgagacttttcaacaaagggtaatatccggaaacctcctcgga
ttccattgcccagctatctgtcactttattgtgaagatagtggaaaagga
aggtggctcctacaaatgccatcattgcgataaaggaaaggccatcgttg
aagatgcctctgccgacagtggtcccaaagatggacccccacccacgagg
agcatcgtggaaaaagaagacgttccaaccacgtcttcaaagcaagtgga
ttgatgtgatatctccactgacgtaagggatgacgcacaatcccactatc
cttcgcaagacccttcctctatataaggaagttcatttcatttggagaga
acacgggggactctaatcaaacaagtttgtacaaaaaagctgaacgagaa
acgtaaaatgatataatggcgttcgatctcaagactgaagacggcctcat
cacatatctcactaaacatcttctcttggacgtcgacacgagcggagtga
agcgccttagcggaggctttgtcaatgtaacctggcgcattaagctcaat
gctccttatcaaggtcatacgagcatcatcctgaagcatgctcagccgca
catgtctacggatgaggattttaagataggtgtagaacgttcggtttacg
aataccaggctatcaagctcatgatggccaatcgggaggttctgggaggc
gtggatggcatagtttctgtgccagaaggcctgaactacgacttagagaa
taatgcattgatcatgcaagatgtcgggaagatgaagacccttttagatt
atgtcaccgccaaaccgccacttgcgacggatatagcccgccttgttggg
acagaaattgggggggttcgttgccagactccataacataggccgcgagag
gcgagacgatcctgagttcaaattcttctctggaaatattgtcggaagga
cgacttcagaccagctgtatcaaaccatcatacccaacgcagcgaaatat
ggcgtcgatgacccccttgctgcctactgtggttaaggaccttgtggacga
tgtcatgcacagcgaagagacccttgtcatggcggacctgtggagtggaa
atattcttctccagttggaggagggaaacccatcgaagctgcagaagata
tatatcctggattgggaactttgcaagtacgcccagcgtcgttggacct
gggctatttcttgggtgactgctatttgatatcccgctttcaagacgagc
aggtcggtacgacgatgcggcaagcctacttgcaaagctatgcgcgtacg |

TABLE 22-continued

Psilocybin expression vector sequences.

| SEQ ID NO. | Name | Sequence |
|---|---|---|
| | | agcaagcattcgatcaactacgccaaagtcactgcaggtattgctgctca |
| | | tattgtgatgtggaccgactttatgcagtgggggagcgaggaagaaagga |
| | | taaattttgtgaaaaaggggggtagctgcctttcacgacgccagggggcaac |
| | | aacgacaatggggaaattacgtctaccttactgaaggaatcatccactgc |
| | | gtaaatcattttacgtttctcgttcagctttcttgtacaaagtggttcga |
| | | tctagaggatccatggtgagcaagggcgaggagctgttcaccggggtggt |
| | | gcccatcctggtcgagctggacggcgacgtgaacggccacaagttcagcg |
| | | tgtccggcgagggcgagggcgatgccacctacggcaagctgaccctgaag |
| | | ttcatctgcaccaccggcaagctgcccgtgccctggcccaccctcgtgac |
| | | caccttcacctacggcgtgcagtgcttcagccgctaccccgaccacatga |
| | | agcagcacgacttcttcaagtccgccatgcccgaaggctacgtccaggag |
| | | cgcaccatcttcttcaaggacgacggcaactacaagacccgcgccgaggt |
| | | gaagttcgagggcgacaccctggtgaaccgcatcgagctgaagggcatcg |
| | | acttcaaggaggacggcaacatcctggggcacaagctggagtacaactac |
| | | aacagccacaacgtctatatcatggccgacaagcagaagaacggcatcaa |
| | | ggtgaacttcaagatccgccacaacatcgaggacggcagcgtgcagctcg |
| | | ccgaccactaccagcagaacacccccatcggcgacggccccgtgctgctg |
| | | cccgacaaccactacctgagcacccagtccgccctgagcaaagaccccaa |
| | | cgagaagcgcgatcacatggtcctgctggagttcgtgaccgccgccggga |
| | | tcactcacggcatggacgagctgtacaagtaaagcggccccgagctcgaat |
| | | tccccgatcgttcaaacatttggcaataaagtttcttaagattgaatcc |
| | | tgttgccggtcttgcgatgattatcatataatttctgttgaattacgtta |
| | | agcatgtaataattaacatgtaatgcatgacgttatttatgagatgggtt |
| | | tttatgattagagtcccgcaattatacatttaatacgcgatagaaaacaa |
| | | aatatagcgcgcaaactaggataaattatcgcgcgcggtgtcatctatgt |
| | | tactagatcgggaattagcttcatcaacgcaagacatgcgcacgaccgtc |
| | | tgacaggagaggaatttccgacgagcacagaaaggacttgctcttggacg |
| | | taggcctatttctcaggcacatgtatcaagtgttcggacgtgggttttcg |
| | | atggtgtatcagccgccgccaactgggagatgaggaggctttcttggggg |
| | | gcagtcagcagttcatttcacaagacagaggaacttgtaaggagatgcac |
| | | tgatttatcttggcgcaaaccagcaggacgaattagtgggaatagcccgc |
| | | gaatatctaagttatgcctgtcggcatgagcagaaacttccaattcgaaa |
| | | cagtttggagaggttgttttttgggcataccttttgttagtcagcctctcg |
| | | attgctcatcgtcattacacagtaccgaagtttgatcgatctagtaacat |
| | | agatgacaccgcgcgcgataatttatcctagtttgcgcgctatattttgt |
| | | tttctatcgcgtattaaatgtataattgcgggactctaatcataaaaacc |
| | | catctcataaataacgtcatgcattacatgttaattattacatgcttaac |
| | | gtaattcaacagaaattatatgataatcatcgcaagaccggcaacaggat |
| | | tcaatcttaagaaactttattgccaaatgtttgaacgatctgcttcgacg |
| | | cactccttctttactccaccatctcgtcctttattgaaaacgtgggtagca |
| | | ccaaaacgaatcaagtcgctggaactgaagttaccaatcacgctggatga |
| | | tttgccagttggattaatcttgccttttcccccgcatgaataatattgatga |
| | | atgcatgcgtgaggggtatttcgattttggcaatagctgcaattgccgcg |
| | | acatcctccaacgagcataattcttcagaaaaatagcgatgttccatgtt |
| | | gtcagggcatgcatgatgcacgttatgaggtgacggtgctaggcagtatt |
| | | ccctcaaagtttcatagtcagtatcatattcatcattgcattcctgcaag |
| | | agagaattgagacgcaatccacacgctgcggcaaccttccggcgttcgtg |
| | | gtctatttgctcttggacgttgcaaacgtaagtgttggatcccggtcggc |
| | | atctactctattcctttgccctcggacgagtgctggggcgtcggtttcca |
| | | ctatcggcgagtacttctacacagccatcggtccagacggccgcgcttct |
| | | gcgggcgatttgtgtacgcccgacagtcccggctccggatcggacgattg |
| | | cgtcgcatcgaccctgcgcccaagctgcatcatcgaaattgccgtcaacc |
| | | aagctctgatagagttggtcaagaccaatgcggagcatatacgcccggag |
| | | ccgcggcgatcctgcaagctccggatgcctccgctcgaagtagcgcgtct |
| | | gctgctccatacaagccaaccacggcctccagaagaagatgttggcgacc |
| | | tcgtattgggaatccccgaacatcgcctcgctccagtcaatgaccgctgt |
| | | tatgcggccattgtccgtcaggacattgttggagccgaaatccgcgtgca |
| | | cgaggtgccggacttcggggcagtcctcggcccaaagcatcagctcatcg |
| | | agagcctgcgcgacggacgcactgacggtgtcgtccatcacagtttgcca |
| | | gtgatacacatggggatcagcaatcgcgcatatgaaatcacgccatgtag |
| | | tgtattgaccgattccttgcggtccgaatgggccgaacccgctcgtctgg |
| | | ctaagatcggccgcagcgatcgcatccatggcctccgcgaccggctgcag |
| | | aacagcgggcagttcggtttcaggcaggtcttgcaacgtgacaccctgtg |
| | | cacggcgggagatgcaataggtcaggctctcgctgaattccccaatgtca |
| | | agcacttccggaatcgggagcgcggccgatgcaaagtgccgataaacata |
| | | acgatctttgtagaaaccatcggcgcagctatttacccgcaggacatatc |
| | | cacgccctcctacatcgaagctgaaagcacgagattcttcgccctccgag |
| | | agctgcatcaggtcggagacgctgtcgaacttttcgatcagaaacttctc |
| | | gacagacgtcgcggtgagttcaggcttttttcatatctcggggtcgtcctctc |
| | | caaatgaaatgaacttccttatatagaggaagggtcttgcgaaggatagt |
| | | gggattgtgcgtcatcccttacgtcagtggagatatcacatcaatccact |
| | | tgctttgaagacgtggttggaacgtcttcttttttccacgatgctcctcgt |
| | | gggggggtccatctttgggaccactgtcggcagaggcatcttgaacgat |
| | | agcctttcctttatcgcaatgatggcatttgtaggtgccaccttccttttt |

TABLE 22-continued

Psilocybin expression vector sequences.

| SEQ ID NO. | Name | Sequence |
|---|---|---|
| | | ctactgtcctttgatgaagtgacagatagctgggcaatggaatccgagg aggtttcccgatattacccttgttgaaaagtctcaatagcccttggtc ttctgagactgtatcttgatattcttggagtagacgagagtgtcgtgct ccaccatgttgacggatctctaggacgcgtcctagaagctaattcactgg ccgtcgttacaacgtcgtgactgggaaaaccctggcgttacccaactt aatcgccttgcagcacatcccctttcgccagctggcgtaatagcgaaga ggcccgcaccgatcgccctcccaacagttgcgcagcctgaatggcgccc gctccttcgctttcttccttcctttctcgccacgttcgccggctttcc ccgtcaagctctaaatcggggctcccttagggttccgatttagtgctt tacggcacctcgaccccaaaaaacttgatttgggtgatggttcacgtagt gggcatcgccctgatagacggttttcgccctttgacgttggagtccac gttctttaatagtggactcttgttccaaactggaacaacactcaaccta tctcgggctattctttgatttataagggattttgccgatttcggaacca ccatcaaacaggattttcgcctgctggggcaaaccagcgtggaccgcttg ctgcaactctctcagggccaggcggtgaagggcaatcagctgttgcccgt ctcactggtgaaaagaaaaaccacccagtacattaaaaacgtccgcaat gtgttattaagttgtctaagcgtcaatttgtttacaccacaatatatcct gccaccagccagccaacagctccccgaccggcagctcggcacaaaatcac cactcgatacaggcagcccatcagtccgggacggcgtcagcgggagagcc gttgtaaggcggcagactttgctcatgttaccgatgctattcggaagaac ggcaactaagctgccgggtttgaaacacggatgatctcgcggagggtagc atgttgattgtaacgatgacagagcgttgctgcctgtgatcaaatatcat ctccctcgcagagatccgaattatcagccttcttattcattctcgctta accgtgacaggctgtcgatcttgagaactatgccgacataataggaaatc gctggataaagccgctgaggaagctgagtggcgctatttctttagaagtg aacgttgacgatatcaactcccctatccattgctcaccgaatggtacagg tcggggacccgaagttccgactgtcggcctgatgcatccccggctgatcg accccagatctgggcgtgagaaagcccagtaaggaaacaactgtaggttc gagtcgcgagatcccccggaaccaaaggaagtaggttaaacccgctccga tcaggccgagccacgccaggccgagaacattggttcctgtaggcatcggg attggcggatcaaacactaaagctactggaacgagcagaagtcctccggc cgccagttgccaggcggtaaaggtgagcagaggcacgggaggttgccact tgcgggtcagcacggttccgaacgccatggaaaccgcccccgccaggccc gctgcgacgccgacaggatctagcgctgcgtttggtgtcaacaccaacag cgccacgcccgcagttccgcaaatagcccccaggaccgccatcaatcgta tcgggctacctagcagagcggcagagatgaacacgaccatcagcggctgc acagcgcctaccgtcgccgcgaccccgcccggcaggcggtagaccgaaat aaacaacaagctccagaatagcgaaatattaagtgcgccgaggatgaaga tgcgcatccaccagattcccgttggaatctgtcggacgatcatcacgagc aataaacccgccggcaacgcccgcagcagcataccggcgaccccctcggcc tgctgttcgggctccacgaaaacgccggacagatgcgccttgtgagcgt ccttggggccgtcctcctgtttgaagaccgacagcccaatgatctcgccg tcgatgtaggcgccgaatgccacggcatctcgcaaccgttcagcgaacgc ctccatgggcttttctcctcgtgctcgtaaacgggcccgaacatctctg gagctttcttcagggccgacaatcggatctcgcggaaatcctgcacgtcg gccgctccaagccgtcgaatctgagccttaatcacaattgtcaatttaa tcctctgtttatcggcagttcgtagagcgcgcgtgcgtcccgagcgata ctgagcgaagcaagtgcgtcgagcagtgcccgcttgttcctgaaatgcca gtaaagcgctggctgctgaaccccagccggaactgacccccacaaggccc tagcgtttgcaatgcaccaggtcatcattgacccaggcgtgttccaccag gccgctgcctcgcaactcttcgcaggcttcgccgacctgctcgcgccact tcttcacgcgggtggaatccgatccgcacatgaggcggaaggttccagc ttgagcgggtacggctcccggtgcgagctgaaatagtcgaacatccgtcg ggccgtcggcgacagcttgcggtacttctcccatatgaatttcgtgtagt ggtcgccagcaaacagcacgacgatttcctcgtcgatcaggacctggcaa cgggacgttttcttgccacggtccaggacgcggaagcggtgcagcagcga caccgattccaggtgcccaacgcggtcggacgtgaagcccatcgccgtcg cctgtaggcgcgacaggcattcctcggccttcgtgtaataccggccattg atcgaccagcccaggtcctggcaaaagctcgtagaacgtgaaggtgatcgg ctcgccgatagggtgcgcttcgcgtactccaacacctgctgccacacca gttcgtcatcgtcggcccgcagctcgacgccggtgtaggtgatcttcacg tccttgttgacgtggaaaatgaccttgttttgcagcgcctcgcgcgggat tttcttgttgcgcgtggtgaacagggcagagcgggccgtgtcgtttggca tcgctcgcatcgtgtccggccacggcgcaatatcgaacaaggaaagctgc atttccttgatctgctgcttcgtgtgtttcagcaacgcggcctgcttggc ctcgctgacctgttttgccaggtcctcgccggggttttcgcttcttggt cgtcatagttcctcgcgtgtcgatggtcatcgacttcgccaaacctgccg cctcctgttcgagacgacgcgaacgctccacggcggccgatggcgcgggc agggcagggggagccagttgcacgctgtcgcgctcgatcttggccgtagc ttgctggaccatcgagccgacggactggaaggtttcgcggggcgcacgca tgacgggtgcggcttgcgatggtttcggcatcctcggcggaaaaccccgcg tcgatcagttcttgcctgtatgccttccgtcaaacgtccgattcattca ccctccttgcgggattgccccgactcacgccggggcaatgtgcccttatt cctgatttgacccgcctggtgccttggtgtccagataatccaccttatcg |

TABLE 22-continued

Psilocybin expression vector sequences.

| SEQ ID NO. | Name | Sequence |
|---|---|---|
| | | gcaatgaagtcggtcccgtagaccgtctggccgtccttctcgtacttggt
attccgaatcttgccctgcacgaataccagcgacccccttgcccaaatact
tgccgtgggcctcggcctgagagccaaaacacttgatgcggaagaagtcg
gtgcgctcctgcttgtcgccggcatcgttgcgccacatctaggtactaaa
acaattcatccagtaaaatataatattttattttctcccaatcaggcttg
atccccagtaagtcaaaaaatagctcgacatactgttcttccccgatatc
ctccctgatcgaccggacgcagaaggcaatgtcataccacttgtccgccc
tgccgcttctcccaagatcaataaagccacttactttgccatcttttcaca
aagatgttgctgtctcccaggtcgccgtgggaaaagacaagttcctcttc
gggcttttccgtctttaaaaaatcatacagctcgcgcggatctttaaatg
gagtgtcttcttcccagttttcgcaatccacatcggccagatcgttattc
agtaagtaatccaattcggctaagcggctgtctaagctattcgtatagg
acaatccgatatgtcgatggagtgaaagagcctgatgcactccgcataca
gctcgataatcttttcagggctttgttcatcttcatactcttccgagcaa
aggacgccatcggcctcactcatgagcagattgctccagccatcatgccg
ttcaaagtgcaggacctttggaacaggcagctttccttccagccatagca
tcatgtccttttcccgttccacatcataggtggtcccttataccggctg
tccgtcatttttaaatataggttttcattttctcccaccagcttatatac
cttagcaggagacattccttccgtatcttttacgcagcggtattttttcga
tcagttttttcaattccggtgatattctcattttagccatttattatttc
cttcctcttttctacagtatttaaagataccccaagaagctaattataac
aagacgaactccaattcactgttccttgcattctaaaaccttaaatacca
gaaaacagcttttttcaaagttgttttcaaagttggcgtataacatagtat
cgacggagccgattttgaaaccacaattatgggtgatgctgccaacttac
tgatttagtgtatgatggtgttttgaggtgctccagtggcttctgtgtc
tatcagctgtccctcctgttcagctactgacggggggtgcgtaacggcaa
aagcaccgccggacatcagcgctatctctgctctcactgccgtaaaacat
ggcaactgcagttcacttacaccgcttctcaacccggtacgcaccagaaa
atcattgatatggccatgaatggcgttggatgccgggcaacagcccgcat
tatgggcgttggcctcaacacgattttacgtcacttaaaaaactcaggcc
gcagtcggtaacctcgcgcatacagccgggcagtgacgtcatcgtctgcg
cggaaatggacgaacagtgggggctatgtcggggctaaatcgcgccagcgc
tggctgttttacgcgtatgacagtctccggaagacggttgttgcgcacgt
attcggtgaacgcactatggcgacgctggggcgtcttatgagcctgctgt
cacccttgacgtggtgatatggatgacggatggctggccgctgtatgaa
tcccgcctgaagggaaagctgcacgtaatcagcaagcgatatacgcagcg
aattgagcggcataacctgaatctgaggcagcacctggcacggctgggac
ggaagtcgctgtcgttctcaaaatcggtggagctgcatgacaaagtcatc
gggcattatctgaacataaaacactatcaataagttggagtcattaccca
attatgatagaatttacaagctataaggttattgtcctgggtttcaagca
ttagtccatgcaagttttttatgctttgcccattctatagatatattgata
agcgcgctgcctatgccttgcccctgaaatccttacatacggcgatatc
ttctatataaaagatatattatcttatcagtattgtcaatatattcaagg
caatctgcctcctcatcctcttcatcctcttcgtcttggtagcttttaa
atatggcgcttcatagagtaattctgtaaaggtccaattctcgttttcat
acctcggtataatcttacctatcacctcaaatggttcgctgggtttatcg
cacccccgaacacgagcacggcacccgcgaccactatgccaagaatgccc
aaggtaaaaattgccggccccgccatgaagtccgtgaatgccccgacggc
cgaagtcgaagggcaggccgccaccaggccgccgccctcactgcccggca
cctggtcgctgaatgtcgatgccagcacctgcgggcacgtcaatgcttccg
ggcgtcgcgctcgggctgatcgcccatcccgttactgccccgatcccggc
aatggcaaggactgccagcgctgccattttgggtgaggccgttcgcgg
ccgagggcgcagcccctgggggatgggaggcccgcgttagcgggccgg
gagggttcgagaaggggggcacccccttcggcgtgcgcggtcacgcgc
acaggggcgcagccctggttaaaaacaaggtttataaatattggtttaaa
gcaggttaaaagacaggttagcggtggccgaaaaacgggcggaaaccctt
gcaaatgctggattttctgcctgtggacagcccctcaaatgtcaataggt
gcgcccctcatctgtcagcactctgcccctcaagtgtcaaggatcgcgcc
cctcatctgtcagtagtcgcgcccctcaagtgtcaataccgcagggcact
tatcccaggcttgtccacatcatctgtgggaaactcgcgtaaaatcagg
cgttttcgccgatttgcgaggctggccagctccacgtcgccggcccgaaat
cgagcctgcccctcatctgtcaacgccgcgcggtgagtcggcccctca
agtgtcaacgtccgcccctcatctgtcagtgagggccaagttttccgcga
ggtatccacaacgccggcggccgcggtgtctcgcacacggcttcgacggc
gtttctggcgcgtttgcagggcatagacggccgccagcccagcggcgag
ggcaaccagcccgg |
| 103 | pGWB5:35S:
PsiHcds:stop | tgagcgtcgcaaaggcgctcggtcttgccttgctcgtcggtgatgtactt
caccagctccgcgaagtcgctcttcttgatggagcgcatggggacgtgct
tggcaatcacgcgcaccccccggccgttttagcggctaaaaaagtcatgg
ctctgccctcgggcggaccacgccatcatgaccttgccaagctcgtcct
gcttctcttcgatcttcgccagcagggcgaggatcgtggcatcaccgaac
cgcgccgtgcgcgggtcgtcggtgagccagagtttcagcaggccgcccag
gcggcccaggtcgccattgatgcgggccagctcgcggacgtgctcatagt |

TABLE 22-continued

Psilocybin expression vector sequences.

| SEQ ID NO. | Name | Sequence |
|---|---|---|
| | | ccacgacgcccgtgattttgtagccctggccgacggccagcaggtaggcc |
| | | gacaggctcatgccggccgccgccgccttttcctcaatcgctcttcgttc |
| | | gtctggaaggcagtacaccttgataggtgggctgcccttcctggttggct |
| | | tggtttcatcagccatccgcttgccctcatctgttacgcggcggtagcc |
| | | ggccagcctcgcagagcaggattcccgttgagcaccgccaggtgcgaata |
| | | agggacagtgaagaaggaacacccgctcgcggggggcctacttcacctat |
| | | cctgcccggctgacgccgttggatacaccaaggaaagtctacacgaaccc |
| | | tttggcaaaatcctgtatatcgtgcgaaaaggatggatataccgaaaaa |
| | | atcgctataatgaccccgaagcagggttatgcagcggaaaagcgccacgc |
| | | ttcccgaagggagaaaggcggacaggtatccggtaagcggcagggtcgga |
| | | acaggagagcgcacgagggagcttccaggggaaacgcctggtatctta |
| | | tagtcctgtcgggtttcgccacctctgacttgagcgtcgattttgtgat |
| | | gctcgtcagggggcggagcctatggaaaaacgccagcaacgcggcctttt |
| | | ttacggttcctggccttttgctggccttttgctcacatgttcttcctgc |
| | | gttatcccctgattctgtggataaccgtattaccgcctttgagtgagctg |
| | | ataccgctcgccgcagccgaacgaccgagcgcagcgagtcagtgagcgag |
| | | gaagcggaagagcgccagaaggccgccagagaggccgagcgcggccgtga |
| | | ggcttggacgctagggcagggcatgaaaaagcccgtagcgggctgctacg |
| | | ggcgtctgacgcggtggaaggggggagggatgttgtctacatggctctg |
| | | ctgtagtgagtgggttgcgctccggcagcggtcctgatcaatcgtcaccc |
| | | tttctcggtccttcaacgttcctgacaacgagcctccttttcgccaatcc |
| | | atcgacaatcaccgcgagtccctgctcgaacgctgcgtccggaccggctt |
| | | cgtcgaaggcgtctatcgcggcccgcaacagcggcgagagcggagcctgt |
| | | tcaacggtgccgccgcgctcgccggcatcgctgtcgccggcctgctcctc |
| | | aagcacggccccaacagtgaagtagctgattgtcatcagcgcattgacgg |
| | | cgtccccggccgaaaaacccgcctcgcagaggaagcgaagctgcgcgtcg |
| | | gccgtttccatctgcggtgcgcccggtcgcgtgccggcatggatgcgcgc |
| | | gccatcgcggtaggcgagcagcgcctgcctgaagctgcgggcattcccga |
| | | tcagaaatgagcgccagtcgtcgtcggctctcggcaccgaatgcgtatga |
| | | ttctccgccagcatggcttcggccagtgcgtcgagcagcgcccgcttgtt |
| | | cctgaagtgccagtaaagcgccggctgctgaaccccaaccgttccgcca |
| | | gtttgcgtgtcgtcagaccgtctacgccgacctggttcaacaggtccagg |
| | | gcggcacggatcactgtattcggctgcaactttgtcatgcttgacacttt |
| | | atcactgataaacataatatgtccaccaacttatcagtgataaagaatcc |
| | | gcgcgttcaatcggaccagcggaggctggtccggaggccagacgtgaaac |
| | | ccaacatacccctgatcgtaattctgagcactgtcgcgctcgacgctgtc |
| | | ggcatcggcctgattatgccggtgctgccgggcctcctgcgcgatctggt |
| | | tcactcgaacgacgtcaccgcccactatggcattctgctggcgctgtatg |
| | | cgttggtgcaatttgcctgcgcacctgtgctgggcgcgctgtcggatcgt |
| | | ttcgggcggcggccaatcttgctcgtctcgctggccggcgccagatctgg |
| | | ggaaccctgtggttggcatgcacatacaaatggacgaacggataaaccctt |
| | | ttcacgccttttaaatatccgattattctaataaacgctctttttctctt |
| | | aggtttacccgccaatatatcctgtcaaacactgatagtttaaactgaag |
| | | ggggaaaacgacaatctgatcatgagcggagaattaagggagtcacgttat |
| | | gacccccgccgatgacgcgggacaagccgttttacgtttggaactgacag |
| | | aaccgcaacgttgaaggagccactcagccgcgggtttctggagtttaatg |
| | | agctaagcacatacgtcagaaaccattattgcgcgttcaaaagtcgccta |
| | | aggtcactatcagctagcaaatattcttgtcaaaaatgctccactgacg |
| | | ttccataaattcccctcggtatccaattagagtctcatattcactctcaa |
| | | tccaaataatctgcaccggatctggatcgtttcgcatgattgaacaagat |
| | | ggattgcacgcaggttctccggccgcttgggtggagaggctattcggcta |
| | | tgactgggcacaacagacaatcggctgctctgatgccgccgtgttccggc |
| | | tgtcagcgcaggggcgcccggttcttttttgtcaagaccgacctgtccggt |
| | | gccctgaatgaactgcaggacgaggcagcgcggctatcgtggctggccac |
| | | gacgggcgttccttgcgcagctgtgctcgacgttgtcactgaagcgggaa |
| | | gggactggctgctattgggcgaagtgccggggcaggatctcctgtcatct |
| | | caccttgctcctgccgagaaagtatccatcatggctgatgcaatgcggcg |
| | | gctgcatacgcttgatccggctacctgcccattcgaccaccaagcgaaac |
| | | atcgcatcgagcgagcacgtactcggatgaagccggtcttgtcgatcag |
| | | gatgatctggacgaagagcatcaggggctcgcgccagccgaactgttcgc |
| | | caggctcaaggcgcgcatgcccgacggcgatgatctcgtcgtgacccatg |
| | | gcgatgcctgcttgccgaatatcatggtggaaaatggccgcttttctgga |
| | | ttcatcgactgtggccggctgggtgtggcggaccgctatcaggacatagc |
| | | gttggctacccgtgatattgctgaagagcttggcggcgaatgggctgacc |
| | | gcttcctcgtgctttacggtatcgccgctcccgattcgcagcgcatcgcc |
| | | ttctatcgccttcttgacgagttcttctgagcgggactctggggttcgaa |
| | | atgaccgaccaagcgacgcccaacctgccatcacgagatttcgattccac |
| | | cgccgccttctatgaaaggttgggcttcggaatcgttttccgggacgccg |
| | | gctggatgatcctccagcgcggggatctcatgctggagttcttcgcccac |
| | | gggatctctgcgggaacaggcggtcgaaggtgccgatatcattacgacagc |
| | | aacgccgacaagcacaacgccacgatcctgagcgacaatatgatcgggc |
| | | ccggcgtccacatcaacggcgtcggcggcgactgcccaggcaagaccgag |
| | | atgcaccgcgatatcttgctgcgttcggatattttcgtggagttcccgcc |
| | | acagacccggatgatccccgatcgttcaaacatttggcaataaagtttct |

TABLE 22-continued

Psilocybin expression vector sequences.

| SEQ ID NO. | Name | Sequence |
|---|---|---|
| | | taagattgaatcctgttgccggtcttgcgatgattatcatataatttctg
ttgaattacgttaagcatgtaataattaacatgtaatgcatgacgttatt
tatgagatgggttttatgattagagtcccgcaattatacatttaatacg
cgatagaaaacaaaatatagcgcgcaaactaggataaattatcgcgcgcg
gtgtcatctatgttactagatcgggcctcctgtcaatgctggcggcggct
ctggtggtggttctggtggcggctctgagggtgtggctctgagggtggc
ggttctgagggtggcggctctgagggaggcggttccggtggtggctctgg
ttccggtgattttgattatgaaaagatggcaaacgctaataaggggcta
tgaccgaaaatgccgatgaaaacgcgctacagtctgacgctaaaggcaaa
cttgattctgtcgctactgattacggtgctgctatcgatggtttcattgg
tgacgtttccggccttgctaatggtaatggtgctactggtgattttgctg
gctctaattcccaaatggctcaagtcggtgacggtgataattcaccttta
atgaataatttccgtcaatatttaccttccctccctcaatcggttgaatg
tcgcccttttgtctttggcccaatacgcaaaccgcctctcccgcgcgtt
ggccgattcattaatgcagctggcacgacaggtttcccgactggaaagcg
ggcagtgagcgcaacgcaattaatgtgagttagctcactcattaggcacc
ccaggctttacactttatgcttccggctcgtatgttgtgtggaattgtga
gcggataacaatttcacacaggaaacagctatgaccatgattacgccaag
cttgcatgcctgcaggtccccagattagccttttcaatttcagaaagaat
gctaacccacagatggttagagaggcttacgcagcaggtctcatcaagac
gatctacccgagcaataatctccaggaaatcaaataccttcccaagaagg
ttaaagatgcagtcaaaagattcaggactaactgcatcaagaacacagag
aaagatatatttctcaagatcagaagtactattccagtatggacgattca
aggcttgcttcacaaaccaaggcaagtaatagagattggagtctctaaaa
aggtagttcccactgaatcaaaggccatggagtcaaagattcaaatagag
gacctaacagaactcgccgtaaagactggcgaacagttcatacagagtct
cttacgactcaatgacaagaagaaaatcttcgtcaacatggtggagcacg
acacacttgtctactccaaaaatatcaaagatacagtctcagaagaccaa
agggcaattgagacttttcaacaaagggtaatatccggaaacctcctcgg
attccattgcccagctatctgtcactttattgtgaagatagtggaaaagg
aaggtggctcctacaaatgccatcattgcgataaaggaaaggccatcgtt
gaagatgcctctgccgacagtggtcccaaagatgacccccacccacgag
gagcatcgtggaaaagaagacgttccaaccacgtcttcaaagcaagtgg
attgatgtgatatctccactgacgtaagggatgacgcacaatcccactat
ccttcgcaagacccttcctctatataaggaagttcatttcatttggagag
aacacggggactctaatcaaacaagtttgtacaaaaaagctgaacgaga
aacgtaaaatgatataaatatcatgatcgctgtactattctccttcgtca
ttgcaggatgcatatactacatcgtttctcgtagagtgaggcggtcgcgc
ttgccaccagggccgcctggcattcctattcccttcattgggaacatgtt
tgatatgcctgaagaatctccatggttaacatttctacaatggggacggg
attacagtctgtcttgccgcgttgacttctaatatatgaacagctaatat
attgtcagacaccgatattctctacgtggatgctggagggacagaaatgg
ttattcttaacacgttggagaccattaccgatctattagaaaagcgaggg
tccatttattctggccggtgagctgatgttgagttttttgcaattgaatt
tgtggtcacacgtttccagacttgagagtacaatggtcaacgaacttatg
gggtgggagtttgacttagggttcatcacatacggcgacaggtggcgcga
agaaaggcgcatgttcgccaaggagttcagtgagaagggcatcaagcaat
ttcgccatgctcaagtgaaagctgcccatcagcttgtccaacagcttacc
aaaacgccagaccgctgggcacaacatattcgccagtaagtactacttga
ggaaaatagcgtacgcttcgctgaccggtccgtacatcaaagtcagatag
cggcaatgtcactggatattggttatggaattgatcttcagaagacgac
ccttggctgaagcgacccatttggctaatgaaggcctcgccatagcatc
agtgccgggcaaattttgggtcgattcgttcccttctcgtgagcatcctt
cttctatgtaggaagggaaggagtctaacaagtgttagtaaaataccttc
ctgcttggttcccaggtgctgtcttcaagcgcaaagcgaaggtctggcga
gaagccgccgaccatatggttgacatgccttatgaaactatgaggaaatt
agcagttagtcaaatgcgttctccccgtatttttcaatactctaacttc
agctcacagcctcaaggattgactcgtccgtcgtatgcttcagctcgtct
gcaagccatggatctcaacggtgaccttgagcatcaagaacacgtaatca
agaacacagccgcagaggttaatgtcggtaagtcaaaagcgtccgtcggc
aattcaaaattcaggcgctaaagtgggtcttctcaccaagtggaggcga
tactgtaaggatttctcaatcgttagagtataagtgttctaatgcagtac
atactccaccaaccagactgtctctgctatgtctgcgttcatcttggcca
tggtgaagtaccctgaggtccagcgaaaggttcaagcggagcttgatgct
ctgaccaataacggccaaattcctgactatgacgaagaagatgactcctt
gccatacctcaccgcatgtatcaaggagcttttccggtggaatcaaatcg
caccccctcgctataccgcacaaattaatgaaggacgacgtgtaccgcggg
tatctgattcccaagaacactctagtcttcgcaaacacctggtgaggctg
tccattcattcctagtacatccgttgcccactaatagcatcttgataac
agggcagtattaaacgatccagaagtctatccagatccctctgtgttccg
cccagaaagatatcttggtcctgacgggaagcctgataacactgtacgcg
acccacgtaaagcggcatttggctatggacgacgaaattggtaagtgcgc
tttcagaaccccccccttccgttgactagtgccatgcgcgcatacaatatc
gctattgatctgatataacttccctgcggcattttattttggcattcctt |

TABLE 22-continued

Psilocybin expression vector sequences.

| SEQ ID NO. | Name | Sequence |
|---|---|---|
| | | agtcccggaattcatctagcgcagtcgacggtttggattgcaggggcaac
cctcttatcagcgttcaatatcgagcgacctgtcgatcagaatgggaagc
ccattgacataccggctgattttactacaggattcttcaggtagctaatt
tccgtctttgtgtgcataatacccctaacgacgcacgtttaccttttgt
aaagacacccagtgcctttccagtgcaggtttgttcctcgaacagagcaa
gtctcacagtcggtatccggaccctgaatatcattttacgtttctcgttc
agctttcttgtacaaagtggttcgatctagaggatccatggtgagcaagg
gcgaggagctgttcaccggggtggtgcccatcctggtcgagctggacggc
gacgtgaacggccacaagttcagcgtgtccggcgagggcgagggcgatgc
cacctacggcaagctgaccctgaagttcatctgcaccaccggcaagctgc
ccgtgccctggcccaccctcgtgaccaccttcacctacggcgtgcagtgc
ttcagccgctaccccgaccacatgaagcagcacgacttcttcaagtccgc
catgcccgaaggctacgtccaggagcgcaccatcttcttcaaggacgacg
gcaactacaagacccgcgccgaggtgaagttcgagggcgacaccctggtg
aaccgcatcgagctgaagggcatcgacttcaaggaggacggcaacatcct
ggggcacaagctggagtacaactacaacagccacaacgtctatatcatgg
ccgacaagcagaagaacggcatcaaggtgaacttcaagatccgccacaac
atcgaggacggcagcgtgcagctcgccgaccactaccagcagaacacccc
catcggcgacggccccgtgctgctgcccgacaaccactacctgagcaccc
agtccgccctgagcaaagaccccaacgagaagcgcgatcacatggtcctg
ctggagttcgtgaccgccgccgggatcactcacggcatggacgagctgta
caagtaaagcggcccgagctcgaatttccccgatcgttcaaacatttggc
aataaagtttcttaagattgaatcctgttgccggtcttgcgatgattatc
atataatttctgttgaattacgttaagcatgtaataattaacatgtaatg
catgacgttatttatgagatgggttttttatgattagagtcccgcaattat
acatttaatacgcgatagaaaacaaatatagcgcgcaaactaggataaa
ttatcgcgcgcggtgtcatctatgttactagatcgggaattagcttcatc
aacgcaagacatgcgcacgaccgtctgacaggagaggaatttccgacgag
cacagaaaggacttgctcttggacgtaggcctattcctcaggcacatgta
tcaagtgttcggacgtgggttttcgatggtgtatcagccgccgccaactg
ggagatgaggaggctttcttgggggggcagtcagcagttcatttcacaaga
cagaggaacttgtaaggagatgcactgatttatcttggcgcaaaccagca
ggacgaattagtgggaatagcccgcgaatatctaagttatgcctgtcggc
atgagcagaaacttccaattcgaaacagtttggagaggttgtttttgggc
ataccttttgttagtcagcctctcgattgctcatcgtcattacacagtac
cgaagtttgatcgatctagtaacatagatgacaccgcgcgcgataattta
tcctagtttgcgcgctatattttgttttctatcgcgtattaaatgtataa
ttgcgggactctaatcataaaaacccatctcataaataacgtcatgcatt
acatgttaattattacatgcttaacgtaattcaacagaaattatatgata
atcatcgcaagaccggcaacaggattcaatcttaagaaactttattgcca
aatgtttgaacgatctgcttcgacgcactccttctttactccaccatctc
gtccttattgaaaacgtgggtagcaccaaaacgaatcaagtcgctggaac
tgaagttaccaatcacgctggatgatttgccagttggattaatcttgcct
ttccccgcatgaataatattgatgaatgcatgcgtgaggggtatttcgat
tttggcaatagctgcaattgccgcgacatcctccaacgagcataattctt
cagaaaaatagcgatgttccatgttgtcagggcatgcatgatgcacgtta
tgaggtgacggtgctaggcagtattccctcaaagtttcatagtcagtatc
atattcatcattgcattcctgcaagagagaattgagacgcaatccacacg
ctgcggcaaccttccggcgttcgtggtctatttgctcttggacgttgcaa
acgtaagtgttggatcccggtcggcatctactctattcctttgccctcgg
acgagtgctgggcgtcggtttccactatcggcgagtacttctacacagc
catcggtccagacggccgcgcttctgcgggcgatttgtgtacgcccgaca
gtcccggctccggatcggacgattgcgtcgcatcgaccctgcgcccaagc
tgcatcatcgaaattgccgtcaaccaagctctgatagagttggtcaagac
caatgcggagcatatacgcccggagccgcggcgatcctgcaagctccgga
tgcctccgctcgaagtagcgcgtctgctgctccatacaagccaaccacgg
cctccagaagaagatgttggcgacctcgtattggaatccccgaacatcg
cctcgctccagtcaatgaccgctgttatgcggccattgtccgtcaggaca
ttgttggagccgaaatccgcgtgcacgaggtgccggacttcggggcagtc
ctcggcccaaagcatcagctcatcgagagcctgcgcgacggacgcactga
cggtgtcgtccatcacagtttgccagtgatacacatggggatcagcaatc
gcgcatatgaaatcacgccatgtagtgtattgaccgattccttgcggtcc
gaatgggccgaacccgctcgtctggctaagatcggccgcagcgatcgcat
ccatggcctccgcgaccggctgcagaacagcgggcagttcggtttcaggc
aggtcttgcaacgtgacaccctgtgcacggcgggagatgcaataggtcag
gctctcgctgaattccccaatgtcaagcacttccggaatcgggagcgcgg
ccgatgcaaagtgccgataaacataacgatctttgtagaaaccatcggcg
cagctatttacccgcaggacatatccacgccctcctacatcgaagctgaa
agcacgagattcttcgccctccgagagctgcatcaggtcggagacgctgt
cgaactttttcgatcagaaacttctcgacagacgtcgcggtgagttcaggc
tttttcatatcggggtcgtcctctccaaatgaaatgaacttccttatata
gaggaagggtcttgcgaaggatagtgggattgtgcgtcatcccttacgtc
agtggagatatcacatcaatccacttgctttgaagacgtggttgaacgt
cttctttttccacgatgctcctcgtgggtgggggtccatctttgggacca |

TABLE 22-continued

Psilocybin expression vector sequences.

| SEQ ID NO. | Name | Sequence |
|---|---|---| ctgtcggcagaggcatcttgaacgatagcctttcctttatcgcaatgatg
gcatttgtaggtgccaccttccttttctactgtccttttgatgaagtgac
agatagctgggcaatggaatccgaggaggtttcccgatattaccctttgt
tgaaaagtctcaatagccctttggtcttctgagactgtatctttgatatt
cttggagtagacgagagtgtcgtgctccaccatgttgacggatctctagg
acgcgtcctagaagctaattcactggccgtcgttttacaacgtcgtgact
gggaaaaccctggcgttacccaacttaatcgccttgcagcacatcccct
ttcgccagctggcgtaatagcgaagaggcccgcaccgatcgcccttccca
acagttgcgcagcctgaatggcgcccgctcctttcgctttcttcccttcc
tttctcgccacgttcgccggctttccccgtcaagctctaaatcgggggct
ccctttaggggttccgatttagtgctttacggcacctcgaccccaaaaaac
ttgatttgggtgatggttcacgtagtgggccatcgccctgatagacggtt
tttcgccctttgacgttggagtccacgttctttaatagtggactcttgtt
ccaaactggaacaacactcaacccatctcgggctattcttttgatttat
aagggatttgccgatttcggaaccaccatcaaacaggattttcgcctgc
tggggcaaaccagcgtggaccgcttgctgcaactctctcagggccaggcg
gtgaagggcaatcagctgttgcccgtctcactggtgaaaagaaaaaccac
cccagtacattaaaaacgtccgcaatgtgttattaagttgtctaagcgtc
aatttgtttacaccacaatatatcctgccaccagccagccaacagctccc
cgaccggcagctcggcacaaaatcaccactcgatacaggcagcccatcag
tccgggacggcgtcagcgggagagccgttgtaaggcggcagactttgctc
atgttaccgatgctattcggaagaacggcaactaagctgccgggtttgaa
acacggatgatctcgcggagggtagcatgttgattgtaacgatgacgagag
cgttgctgcctgtgatcaaatatcatctccctcgcagagatccgaattat
cagccttcttattcatttctcgcttaaccgtgacaggctgtcgatcttga
gaactatgccgacataataggaaatcgctggataaagccgctgaggaagc
tgagtggcgctatttctttagaagtgaacgttgacgatatcaactcccct
atccattgctcaccgaatggtacaggtcggggacccgaagttccgactgt
cggcctgatgcatccccggctgatcgaccccagatctggggctgagaaag
cccagtaaggaaacaactgtaggttcgagtcgcgagatccccggaacca
aaggaagtaggttaaacccgctccgatcaggccgagccacgccaggccga
gaacattggttcctgtaggcatcgggattggcggatcaaacactaaagct
actggaacgagcagaagtcctccggccgccagttgccaggcggtaaaggt
gagcagaggcacgggaggttgccacttgcgggtcagcacggttccgaacg
ccatggaaaccgccccgccaggcccgctgcgacgccgacaggatctagc
gctgcgtttggtgtcaacaccaacagcgccacgcccgcagttccgcaaat
agcccccaggaccgccatcaatcgtatcgggctacctagcagagcggcag
agatgaaacgaccatcagcggctgcacagcgcctaccgtcgccgcgacc
ccgcccggcaggcggtagaccgaaataaacaacaagctccagaatagcga
aatattaagtgcgccgaggatgaagatgcgcatccaccagattcccgttg
gaatctgtcggacgatcatcacgagcaataaaccgccggcaacgcccgc
agcagcataccggcgacccctcggcctcgctgttcgggctccacgaaaac
gccggacagatgcgccttgtgagcgtccttggggccgtcctcctgtttga
agaccgacagcccaatgatctcgccgtcgatgtaggcgccgaatgccacg
gcatctcgcaaccgttcagcgaacgcctccatgggctttttctcctcgtg
ctcgtaaacggacccgaacatctctggagctttcttcagggccgacaatc
ggatctcgcggaaatcctgcacgtcggccgctccaagccgtcgaatctga
gccttaatcacaattgtcaatttttaatcctctgtttatcggcagttcgta
gagcgcgccgtgcgtcccgagcgatactgagcgaagcaagtgcgtcgagc
agtgcccgcttgttcctgaaatgccagtaaagcgctggctgctgaacccc
cagccggaactgaccccacaaggccctagcgtttgcaatgcaccaggtca
tcattgacccaggcgtgttccaccaggccgctgcctcgcaactcttcgca
ggcttcgccgacctgctcgcgcgccacttcttcacgcgggtggaatccgatc
cgcacatgaggcggaaggtttccagcttgagcgggtacggctcccggtgc
gagctgaaatagtcgaacatccgtcgggccgtcggcgacagcttgcggta
cttctcccatatgaatttcgtgtagtggtcgccagcaaacagcacgacga
tttcctcgtcgatcaggacctggcaacgggacgttttcttgccacggtcc
aggacgcggaagcggtgcagcagcgacaccgattccaggtgcccaacgcg
gtcggacgtgaagcccatcgccgtcgcctgtaggcgcgacaggcattcct
cggccttcgtgtaataccgccattgatcgaccagcccaggtcctggcaa
agctcgtagaacgtgaaggtgatcggctcgccgatagggtgcgcttcgc
gtactccaacacctgctgccacaccagttcgtcatcgtcggcccgcagct
cgacgccggtgtaggtgatcttcacgtccttgttgacgtggaaaatgacc
ttgttttgcagcgcctcgcgcgggattttcttgttgcgcgtggtgaacag
ggcagagcgggccgtgtcgtttggcatcgctcgcatcgtgtccggccacg
gcgcaatatcgaacaaggaaagctgcatttccttgatctgctgcttcgtg
tgtttcagcaacgcggcctgcttggcctcgctgacctgttttgccaggtc
ctcgccggcggttttcgcttcttggtcgtcatagttcctcgcgtgtcga
tggtcatcgacttcgccaaaacctgccgcctcctgttcgagacgacgcgaa
cgctccacggcggccgatggcgcgggcagggcaggggagccagttgcac
gctgtcgcgctcgatcttggccgtagcttgctggaccatcgagccgacgg
actgaaggtttcgcggggcgcacgcatgacggtgcggcttgcgatggtt
tcggcatcctcggcggaaaaccccgcgtcgatcagttcttgcctgtatgc
cttccggtcaaacgtccgattcattcaccctccttgcgggattgccccga

TABLE 22-continued

Psilocybin expression vector sequences.

| SEQ ID NO. | Name | Sequence |
|---|---|---|
| | | ctcacgccggggcaatgtgcccttattcctgatttgacccgcctggtgcc<br>ttggtgtccagataatccaccttatcggcaatgaagtcggtcccgtagac<br>cgtctggccgtccttctcgtacttggtattccgaatcttgccctgcacga<br>ataccagcgaccccttgcccaaatacttgccgtgggcctcggcctgagag<br>ccaaaacacttgatgcggaagaagtcggtgcgctcctgcttgtcgccggc<br>atcgttgcgccacatctaggtactaaaacaattcatccagtaaaatataa<br>tattttattttctcccaatcaggcttgatccccagtaagtcaaaaaatag<br>ctcgacatactgttcttccccgatatcctccctgatcgaccggacgcaga<br>aggcaatgtcataccacttgtccgccctgccgcttctcccaagatcaata<br>aagccacttactttgccatcttcacaaagatgttgctgtctcccaggtc<br>gccgtgggaaaagacaagttcctcttcgggcttttccgtcttaaaaaat<br>catacagctcgcgcggatctttaaatggagtgtcttcttcccagttttcg<br>caatccacatcggccagatcgttattcagtaagtaatccaattcggctaa<br>gcggctgtctaagctattcgtatagggacaatccgatatgtcgatggagt<br>gaaagagcctgatgcactccgcatacagctcgataatcttttcagggctt<br>tgttcatcttcatactcttccgagcaaaggacgccatcggcctcactcat<br>gagcagattgctccagccatcatgccgttcaaagtgcaggacctttggaa<br>caggcagcttttccttccagccatagcatcatgtccttttcccgttccaca<br>tcataggtggtcccttataccggctgtccgtcatttttaaatataggtt<br>ttcattttctcccaccagcttatataccttagcaggagacattccttccg<br>tatcttttacgcagcggtatttttcgatcagttttttcaattccggtgat<br>attctcatttttagccatttattattttccttcctcttttctacagtattta<br>aagataccccaagaagctaattataacaagacgaactccaattcactgtt<br>ccttgcattctaaaaccttaaataccagaaaacagctttttcaaagttgt<br>tttcaaagttggcgtataacatagtatcgacggagccgattttgaaacca<br>caattatgggtgatgctgccaacttactgatttagtgtatgatggtgttt<br>ttgaggtgctccagtggcttctgtgtctatcagctgtccctcctgttcag<br>ctactgacggggtggtgcgtaacggcaaaagcaccgccggacatcagcgc<br>tatctctgtctcactgccgtaaaacatggcaactgcagttcacttacac<br>cgcttctcaacccggtacgcaccagaaaatcattgatatggccatgaatg<br>gcgttggatgccgggcaacagcccgcattatgggcgttggcctcaacacg<br>attttacgtcacttaaaaaactcaggccgcagtcggtaacctcgcgcata<br>cagccgggcagtgacgtcatcgtctgcgcggaaatggacgaacagtgggg<br>ctatgtcggggctaaatcgcgccagcgctggctgttttacgcgtatgaca<br>gtctccggaagacggttgttgcgcacgtattcggtgaacgcactatggcg<br>acgctgggcgtcttatgagcctgctgtcacccttttgacgtggtgatatg<br>gatgacggatggctggccgctgtatgaatcccgcctgaagggaaagctgc<br>acgtaatcagcaagcgatatacgcagcgaattgagcggcataacctgaat<br>ctgaggcagcacctggcacggctgggacgaagtcgctgtcgttctcaaa<br>atcggtggagctgcatgacaaagtcatcgggcattatctgaacataaaac<br>actatcaataagttggagtcattacccaattatgatagaatttacaagct<br>ataaggttattgtcctgggtttcaagcattagtccatgcaagttttatg<br>ctttgcccattctatagatatattgataagcgcgctgcctatgccttgcc<br>ccctgaaatccttacatacggcgatatcttctatataaaagatatattat<br>cttatcagtattgtcaatatattcaaggcaatctgcctcctcatcctctt<br>catcctcttcgtcttggtagcttttttaaatatggcgcttcatagagtaat<br>tctgtaaaggtccaattctcgttttcatacctcggtataatcttacctat<br>cacctcaaatggttcgctgggtttatcgcaccccccgaacacgagcacggc<br>accgcgaccactatgccaagaatgcccaaggtaaaaattgccggccccg<br>ccatgaagtccgtgaatgccccgacggccgaagtgaagggcaggccgcca<br>cccaggccgccgccctcactgcccggcacctggtcgctgaatgtcgatgc<br>cagcacctgcggcacgtcaatgcttccgggcgtcgcgctcgggctgatcg<br>cccatcccgttactgccccgatcccggcaatggcaaggactgccagcgct<br>gccattttggggtgaggccgttcgcggccgaggggcgcagcccctgggg<br>ggatgggaggccgcgttagcgggccgggagggttcgagaagggggggca<br>ccccccttcggcgtgcgcggtcacgcgcacagggcgcagccctggttaaa<br>aacaaggtttataaatattggtttaaaagcaggttaaaagacaggttagc<br>ggtggccgaaaaacgggcgaaaaccttgcaaatgctggattttctgcct<br>gtggacagcccctcaaatgtcaataggtgcgcccctcatctgtcagcact<br>ctgccctcaagtgtcaaggatcgcgcccctcatctgtcagtagtcgcgc<br>ccctcaagtgtcaataccgcagggcacttatcccaggcttgtccacatc<br>atctgtgggaaactcgcgtaaaatcaggcgttttcgccgatttgcgaggc<br>tggccagctccacgtcgccggccgaaatcgagcctgcccctcatctgtca<br>acgccgcgccggtgagtcggcccctcaagtgtcaacgtccgcccctcat<br>ctgtcagtgagggccaagttttccgcgaggtatccacaacgccggcggcc<br>gcggtgtctcgcacacggcttcgacggcgtttctggcgcgtttgcagggc<br>catagacggccgccagcccagcggcgagggcaaccagcccgg |
| 104 | pGWB5:35S:<br>PsiDcds:stop | tgagcgtcgcaaaggcgctcggtcttgccttgctcgtcggtgatgtactt<br>caccagctccgcgaagtcgctcttcttgatggagcgcatggggacgtgct<br>tggcaatcacgcgcaccccggcgttttagcggctaaaaaagtcatgg<br>ctctgccctcgggcggaccacgccatcatgaccttgccaagctcgtcct<br>gcttctcttcgatcttcgccagcagggcgaggatcgtggcatcaccgaac<br>cgcgccgtgcgcgggtcgtcggtgagccagagtttcagcaggccgcccag |

TABLE 22-continued

Psilocybin expression vector sequences.

| SEQ ID NO. | Name | Sequence |
|---|---|---|
| | | gcggcccaggtcgccattgatgcgggccagctcgcggacgtgctcatagt |
| | | ccacgacgcccgtgattttgtagccctggccgacggccagcaggtaggcc |
| | | gacaggctcatgccggccgccgccgccttttcctcaatcgctcttcgttc |
| | | gtctggaaggcagtacaccttgataggtgggctgcccttcctggttggct |
| | | tggtttcatcagccatccgcttgccctcatctgttacgccggggtagccg |
| | | gccagcctcgcagagcaggattcccgttgagcaccgccaggtgcgaataa |
| | | gggacagtgaagaaggaacacccgctcgcgggggggcctacttcacctatc |
| | | ctgcccggctgacgccgttggatacaccaaggaaagtctacacgaaccct |
| | | ttggcaaaatcctgtatatcgtgcgaaaaaggatggatataccgaaaaaa |
| | | tcgctataatgaccccgaagcagggttatgcagcggaaaagcgccacgct |
| | | tcccgaagggagaaaggcggacaggtatccggtaagcggcagggtcggaa |
| | | caggagagcgcacgagggagcttccaggggggaaacgcctggtatctttat |
| | | agtcctgtcgggtttcgccacctctgacttgagcgtcgattttttgtgatg |
| | | ctcgtcagggggcggagcctatggaaaaacgccagcaacgcggcctttt |
| | | tacggttcctggccttttgctggcttttgctcacatgttctttcctgcg |
| | | ttatcccctgattctgtggataaccgtattaccgcctttgagtgagctga |
| | | taccgctcgccgcagccgaacgaccgagcgcagcgagtcagtgagcgagg |
| | | aagcggaagagcgcccagaaggccgccagagaggccgagcgcggccgtgag |
| | | gcttggacgctagggcagggcatgaaaaagcccgtagcgggctgctacgg |
| | | gcgtctgacgcggtggaaaggggaggggatgttgtctacatggctctgc |
| | | tgtagtgagtgggttgcgctccggcagcggtcctgatcaatcgtcaccct |
| | | ttctcggtccttcaacgttcctgacaacgagcctccttttcgccaatcca |
| | | tcgacaatcaccgcgagtccctgctcgaacgctgcgtccggaccggcttc |
| | | gtcgaaggcgtctatcgcggcccgcaacagcggcgagagcggagcctgtt |
| | | caacggtgccgccgcgctcgccggcatcgctgtcgccggcctgctcctca |
| | | agcacggccccaacagtgaagtagctgattgtcatcagcgcattgacggc |
| | | gtccccggccgaaaaacccgcctcgcagaggaagcgaagctgcgcgtcgg |
| | | ccgtttccatctgcggtgcgcccggtcgcgtgccggcatggatgcgcgcg |
| | | ccatcgcggtaggcgagcagcgcctgcctgaagctgcgggcattcccgat |
| | | cagaaatgagcgccagtcgtcgtcggctctcggcaccgaatgcgtatgat |
| | | tctccgccagcatggcttcggccagtgcgtcgagcagcgcccgcttgttc |
| | | ctgaagtgccagtaaagcgccggctgctgaaccccccaaccgttccgccag |
| | | tttgcgtgtcgtcagaccgtctacgccgacctcgttcaacaggtccaggg |
| | | cggcacggatcactgtattcggctgcaactttgtcatgcttgacactta |
| | | tcactgataaacataatatgtccaccaacttatcagtgataaagaatccg |
| | | cgcgttcaatcggaccagcggaggctggtccggaggccagacgtgaaacc |
| | | caacatacccctgatcgtaattctgagcactgtcgcgctcgacgctgtcg |
| | | gcatcggcctgattatgccggtgctgccgggcctcctgcgcgatctggtt |
| | | cactcgaacgacgtcaccgccactatggcattctgctggcgctgtatgc |
| | | gttggtgcaatttgcctgcgcacctgtgctgggcgcgctgtcggatcgtt |
| | | tcgggcggcggccaatcttgctcgtctcgctggccggcgccagatctggg |
| | | gaaccctgtggttggcatgcacatacaaatggacgaacggataaacctt |
| | | tcacgcccttttaaatatccgattattctaataaacgctcttttctctta |
| | | ggtttacccgccaatatcctgtcaaacactgatagtttaaactgaagg |
| | | cgggaaacgacaatctgatcatgagcggagaattaagggagtcacgttat |
| | | gaccccgccgatgacgcgggacaagccgttttacgtttggaactgacag |
| | | aaccgcaacgttgaaggagccactcagccgcgggtttctggagtttaatg |
| | | agctaagcacatacgtcagaaaccattattgcgcgttcaaaagtcgccta |
| | | aggtcactatcagctagcaaatatttcttgtcaaaaatgctccactgacg |
| | | ttccataaattcccctcggtatccaattagagtctcatattcactctcaa |
| | | tccaaataatctgcaccggatctggatcgtttcgcatgattgaacaagat |
| | | ggattgcacgcaggttctccggccgcttgggtggagaggctattcggcta |
| | | tgactgggcacaacagacaatcggctgctctgatgccgccgtgttccggc |
| | | tgtcagcgcaggggcgcccggttcttttttgtcaagaccgacctgtccggt |
| | | gccctgaatgaactgcaggacgaggcagcgcggctatcgtggctggccac |
| | | gacgggcgttccttgcgcagctgtgctcgacgttgtcactgaagcgggaa |
| | | gggactggctgctattgggcgaagtgccggggcaggatctcctgtcatct |
| | | caccttgctcctgccgagaaagtatccatcatggctgatgcaatgcggcg |
| | | gctgcatacgcttgatccggctacctgcccattcgaccaccaagcgaaac |
| | | atcgcatcgagcgagcacgtactcggatggaagccggtcttgtcgatcag |
| | | gatgatctggacgaagagcatcaggggctcgcgccagccgaactgttcgc |
| | | caggctcaaggcgcgcatgcccgacggcgatgatctcgtcgtgacccatg |
| | | gcgatgcctgcttgccgaatatcatggtggaaaatggccgcttttctgga |
| | | ttcatcgactgtggccggctgggtgtggcggaccgctatcaggacatagc |
| | | gttggctacccgtgatattgctgaagagcttggcggcgaatgggctgacc |
| | | gcttcctcgtgctttacggtatcgccgctcccgattcgcagcgcatcgcc |
| | | ttctatcgccttcttgacgagttcttctgagcgggactctggggttcgaa |
| | | atgaccgaccaagcgacgcccaacctgccatcacgagatttcgattccac |
| | | cgccgccttctatgaaaggttgggcttcggaatcgttttccgggacgccg |
| | | gctggatgatcctccagcgcggggatctcatgctggagttcttcgcccac |
| | | gggatctctgcggaacaggcggtcgaaggtgccgatatcattacgacagc |
| | | aacgccgacaagcacaacgccacgatcctgagcgacaatatgatcgggc |
| | | ccggcgtccacatcaacggcgtcggcggcgactgcccaggcaagaccgag |
| | | atgcaccgcgatatcttgctgcgcgttcggatattttcgtggagttcccgcc |

TABLE 22-continued

Psilocybin expression vector sequences.

| SEQ ID NO. | Name | Sequence |
|---|---|---|
| | | acagacccggatgatccccgatcgttcaaacatttggcaataaagtttct |
| | | taagattgaatcctgttgccggtcttgcgatgattatcatataatttctg |
| | | ttgaattacgttaagcatgtaataattaacatgtaatgcatgacgttatt |
| | | tatgagatgggttttatgattagagtcccgcaattatacatttaatacg |
| | | cgatagaaaacaaaatatagcgcgcaaactaggataaattatcgcgcgcg |
| | | gtgtcatctatgttactagatcgggcctcctgtcaatgctggcggcggct |
| | | ctggtggtggttctggtggcggctctgagggtggtggctctgagggtggc |
| | | ggttctgagggtggcggctctgagggaggcggttccggtggtggctctgg |
| | | ttccggtgattttgattatgaaaagatggcaaacgctaataaggggcta |
| | | tgaccgaaaatgccgatgaaaacgcgctacagtctgacgctaaaggcaaa |
| | | cttgattctgtcgctactgattacggtgctgctatcgatggtttcattgg |
| | | tgacgtttccggccttgctaatggtaatggtgctactggtgattttgctg |
| | | gctctaattcccaaatggctcaagtcggtgacggtgataattcacctta |
| | | atgaataatttccgtcaatatttaccttcctccctcaatcggttgaatg |
| | | tcgcccttttgtctttggcccaatacgcaaaccgcctctccccgcgcgtt |
| | | ggccgattcattaatgcagctggcacgacaggtttcccgactggaaagcg |
| | | ggcagtgagcgcaacgcaattaatgtgagttagctcactcattaggcacc |
| | | ccaggctttacactttatgcttccggctcgtatgttgtgtggaattgtga |
| | | gcggataacaatttcacacaggaaacagctatgaccatgattacgccaag |
| | | cttgcatgcctgcaggtccccagattagccttttcaatttcagaaagaat |
| | | gctaacccacagatggttagagaggcttacgcagcaggtctcatcaagac |
| | | gatctacccgagcaataatctccaggaaatcaaatacettcccaagaagg |
| | | ttaaagatgcagtcaaaagattcaggactaactgcatcaagaacacagag |
| | | aaagatatatttctcaagatcagaagtactattccagtatggacgattca |
| | | aggcttgcttcacaaaccaaggcaagtaatagagattggagtctctaaaa |
| | | aggtagttcccactgaatcaaaggccatggagtcaaagattcaaatagag |
| | | gacctaacagaactcgccgtaaagactggcgaacagttcatacagagtct |
| | | cttacgactcaatgacaagaagaaaatcttcgtcaacatggtggagcacg |
| | | acacacttgtctactccaaaaatatcaaagatacagtctcagaagaccaa |
| | | agggcaattgagacttttcaacaaagggtaatatccggaaacctcctcgg |
| | | attccattgcccagctatctgtcactttattgtgaagatagtggaaaagg |
| | | aaggtggctcctacaaatgccatcattgcgataaaggaaaggccatcgtt |
| | | gaagatgcctctgccgacagtggtcccaaagatggaccccacccacgag |
| | | gagcatcgtggaaaaagaagacgttccaaccacgtcttcaaagcaagtgg |
| | | attgatgtgatatctccactgacgtaagggatgacgcacaatcccactat |
| | | ccttcgcaagacccttcctctatataaggaagttcatttcatttggagag |
| | | aacacggggactctaatcaaacaagtttgtacaaaaaagctgaacgaga |
| | | aacgtaaaatgatataaatatgcaggtgatacccgcgtgcaactcggcag |
| | | caataagatcactatgtcctactcccgagtcttttagaaacatgggatgg |
| | | ctctctgtcagcgatgcggtctacagcgagttcataggagagttggctac |
| | | ccgcgcttccaatcgaaattactccaacgagttcggcctcatgcaaccta |
| | | tccaggaattcaaggctttcattgaaagcgacccggtggtgcaccaagaa |
| | | tttattgacatgttcgagggcattcaggactctccaaggaattatcagga |
| | | actatgtaatatgttcaacgatatctttcgcaaagctcccgtctacggag |
| | | accttggccctcccgtttatatgattatggccaaattaatgaacacccga |
| | | gcgggcttctctgcattcacgagacaaaggttgaaccttcacttcaaaaa |
| | | actttcgatacctggggattgttcctgtcttcgaaagattctcgaaatg |
| | | ttcttgtggccgaccagttcgacgacagacattgcggctggttgaacgag |
| | | cgggcctgtctgctatggttaaacattacaatggacgcgcatttgatga |
| | | agtcttcctctgcgataaaaatgccccatactacggcttcaactcttacg |
| | | acgacttctttaatcgcagatttcgaaaccgagatatcgaccgacctgta |
| | | gtcggtggagttaacaacaccaccctcatttctgctgcttgcgaatcact |
| | | ttcctacaacgtctcttatgacgtccagtctctcgacactttagttttca |
| | | aaggagagacttattcgcttaagcatttgctgaataatgacccctttcacc |
| | | ccacaattcgagcatgggagtattctacaaggattcttgaacgtcaccgc |
| | | ttaccaccgatggcacgcacccgtcaatgggacaatcgtcaaaatcatca |
| | | acgttccaggtacctactttgcgcaagccccgagcacgattggcgaccct |
| | | atcccggataacgattacgacccacctccttaccttaagtctcttgtcta |
| | | cttctctaatattgccgcaaggcaaattatgtttattgaagccgacaaca |
| | | aggaaattggcctcattttccttgtgttcatcggcatgaccgaaatctcg |
| | | acatgtgaagccacggtgtccgaaggtcaacacgtcaatcgtggcgatga |
| | | cttgggaatgttccatttcggtggttcttcgttcgcgcttggtctgagga |
| | | aggattgcagggcagagatcgttgaaaagttcaccgaacccggaacagtg |
| | | atcagaatcaacgaagtcgtcgctgctctaaaggcttagtacgtttctcg |
| | | ttcagctttcttgtacaaagtggttcgatctagaggatccatggtgagca |
| | | agggcgaggagctgttcaccgggggtgcccatcctggtcgagctggacg |
| | | gcgacgtgaacggccacaagttcagcgtgtccggcgagggcgagggcgat |
| | | gccacctacggcaagctgaccctgaagttcatctgcaccaccggcaagct |
| | | gcccgtgccctggcccaccctcgtgaccaccttcacctacggcgtgcagt |
| | | gcttcagccgctaccccgaccacatgaagcagcacgacttcttcaagtcc |
| | | gccatgcccgaaggctacgtccaggagcgcaccatcttcttcaaggacga |
| | | cggcaactacaagacccgcgccgaggtgaagttcgagggcgacaccctgg |
| | | tgaaccgcatcgagctgaagggcatcgacttcaaggaggacggcaacatc |
| | | ctggggcacaagctggagtacaactacaacagccacaacgtctatatcat |

TABLE 22-continued

Psilocybin expression vector sequences.

| SEQ ID NO. | Name | Sequence |
|---|---|---|
| | | ggccgacaagcagaagaacggcatcaaggtgaacttcaagatccgccaca
acatcgaggacggcagcgtgcagctcgccgaccactaccagcagaacacc
cccatcggcgacggccccgtgctgctgcccgacaaccactacctgagcac
ccagtccgccctgagcaaagacccaacgagaagcgcgatcacatggtcc
tgctggagttcgtgaccgccgccgggatcactcacggcatggacgagctg
tacaagtaaagcggcccgagctcgaatttccccgatcgttcaaacatttg
gcaataaagtttcttaagattgaatcctgttgccggtcttgcgatgatta
tcatataatttctgttgaattacgttaagcatgtaataattaacatgtaa
tgcatgacgttatttatgagatgggttttatgattagagtcccgcaatt
atacatttaatacgcgatagaaaacaaaatatagcgcgcaaactaggata
aattatcgcgcgcggtgtcatctatgttactagatcgggaattagcttca
tcaacgcaagacatgcgcacgaccgtctgacaggagaggaatttccgacg
agcacagaaaggacttgctcttggacgtaggcctatttctcaggcacatg
tatcaagtgttcggacgtgggttttcgatggtgtatcagccgccgccaac
tgggagatgaggaggctttcttgggggcagtcagcagttcatttcacaa
gacagaggaacttgtaaggagatgcactgatttatcttggcgcaaaccag
caggacgaattagtgggaatagcccgcgaatatctaagttatgcctgtcg
gcatgagcagaaacttccaattcgaaacagtttggagaggttgttttgg
gcatacctttgttagtcagcctctcgattgctcatcgtcattacacagt
accgaagtttgatcgatctagtaacatagatgacaccgcgcgcgataatt
tatcctagtttgcgcgctatattttgttttctatcgcgtattaaatgtat
aattgcgggactctaatcataaaaaccatctcataaataacgtcatgca
ttacatgttaattattacatgcttaacgtaattcaacagaaattatatga
taatcatcgcaagaccggcaacaggattcaatcttaagaaactttattgc
caaatgtttgaacgatctgcttcgacgcactccttctttactccaccatc
tcgtccttattgaaaacgtgggtagcaccaaaacgaatcaagtcgctgga
actgaagttaccaatcacgctggatgatttgccagttggattaatcttgc
ctttccccgcatgaataatattgatgaatgcatgcgtgaggggtatttcg
attttggcaatagctgcaattgccgcgacatcctccaacgagcataattc
ttcagaaaaatagcgatgttccatgttgtcagggcatgcatgatgcacgt
tatgaggtgacggtgctaggcagtattccctcaaagtttcatagtcagta
tcatattcatcattgcattcctgcaagagagaattgagacgcaatccaca
cgctgcggcaaccttccggcgttcgtggtctatttgctcttggacgttgc
aaacgtaagtgttggatcccggtcggcatctactctattcctttgccctc
ggacgagtgctgggcgtcggtttccactatcggcgagtacttctacaca
gccatcggtccagacggccgcgcttctgcgggcgatttgtgtacgcccga
cagtcccggctccggatcggacgattgcgtcgcatcgaccctgcgcccaa
gctgcatcatcgaaattgccgtcaaccaagctctgatagagttggtcaag
accaatgcggagcatatacgcccggagccgcggcgatcctgcaagctccg
gatgcctccgctcgaagtagcgcgtctgctgctccatacaagccaaccac
ggcctccagaagaagatgttggcgacctcgtattgggaatccccgaacat
cgcctcgctccagtcaatgaccgctgttatgcggccattgtccgtcagga
cattgttggagccgaaatccgcgtgcacgaggtgccggacttcggggcag
tcctcggcccaaagcatcagctcatcgagagcctgcgcgacggacgcact
gacggtgtcgtccatcacagtttgccagtgatacacatggggatcagcaa
tcgcgcatatgaaatcacgccatgtagtgtattgaccgattccttgcggt
ccgaatgggccgaacccgctcgtctggctaagatcggccgcagcgatcgc
atccatggcctccgcgaccggctgcagaacagcgggcagttcggtttcag
gcaggtcttgcaacgtgacaccctgtgcacggcgggagatgcaataggtc
aggctctcgctgaattcccaatgtcaagcacttccggaatcgggagcgc
ggccgatgcaaagtgccgataaacataacgatctttgtagaaaccatcgg
cgcagctatttacccgcaggacatatccacgcccctctacatcgaagctg
aaagcacgagattcttcgccctccgagagctgcatcaggtcggagacgct
gtcgaacttttcgatcagaaacttctcgacagacgtcgcggtgagttcag
gctttttcatatcgggtcgtcctctccaaatgaaatgaacttccttata
tagaggaagggtcttgcgaaggatagtgggattgtgcgtcatcccttacg
tcagtggagatatcacatcaatccacttgctttgaagacgtggttggaac
gtcttctttttccacgatgctcctcgtgggtgggggtccatctttgggac
cactgtcggcagaggcatcttgaacgatagcctttccttatcgcaatga
tggcatttgtaggtgccaccttccttttctactgtccttttgatgaagtg
acagatagctgggcaatggaatccgaggaggtttcccgatattacccttt
gttgaaaagtctcaatagcccttggtcttctgagactgtatctttgata
ttcttggagtagacgagagtgtcgtgctccaccatgttgacggatctcta
ggacgcgtcctagaagctaattcactggccgtcgtttacaacgtcgtga
ctgggaaaaccctggcgttacccaacttaatcgccttgcagcacatcccc
ctttcgccagctggcgtaatagcgaagaggcccgcaccgatcgcccttcc
caacagttgcgcagcctgaatggcgaccgctccttttcgctttcttcccttt
cctttctcgccacgttcgccggctttccccgtcaagctctaaatcggggg
ctccctttagggttccgatttagtgctttacggcacctcgaccccaaaaa
acttgatttgggtgatggttcacgtagtgggccatcgccctgatagacgg
tttttcgccctttgacgttggagtccacgttctttaatagtggactcttg
ttccaaactggaacaacactcaaccctatctcgggctattcttttgattt
ataagggattttgccgatttcggaaccaccatcaaacaggattttcgcct
gctggggcaaaccagcgtggaccgcttgctgcaactctctcagggccagg |

TABLE 22-continued

Psilocybin expression vector sequences.

| SEQ ID NO. | Name | Sequence |
|---|---|---|
| | | cggtgaagggcaatcagctgttgcccgtctcactggtgaaaagaaaaacc |
| | | accccagtacattaaaaacgtccgcaatgtgttattaagttgtctaagcg |
| | | tcaatttgtttacaccacaatatatcctgccaccagccagccaacagctc |
| | | cccgaccggcagctcggcacaaaatcaccactcgatacaggcagcccatc |
| | | agtccgggacggcgtcagcgggagagccgttgtaaggcggcagactttgc |
| | | tcatgttaccgatgctattcggaagaacggcaactaagctgccgggtttg |
| | | aaacacggatgatctcgcggagggtagcatgttgattgtaacgatgacag |
| | | agcgttgctgcctgtgatcaaatatcatctccctcgcagagatccgaatt |
| | | atcagccttcttattcatttctcgcttaaccgtgacaggctgtcgatctt |
| | | gagaactatgccgacataataggaaatcgctggataaagccgctgaggaa |
| | | gctgagtggcgctatttctttagaagtgaacgttgacgatatcaactccc |
| | | ctatccattgctcaccgaatggtacaggtcggggacccgaagttccgact |
| | | gtcggcctgatgcatccccggctgatcgaccccagatctggggctgagaa |
| | | agcccagtaaggaaacaactgtaggttcgagtcgcgagatcccccggaac |
| | | caaaggaagtaggttaaacccgctccgatcaggccgagccacgccaggcc |
| | | gagaacattggttcctgtaggcatcgggattggcggatcaaacactaaag |
| | | ctactggaacgagcagaagtcctccggccgccagttgccaggcggtaaag |
| | | gtgagcagaggcacgggaggttgccacttgcgggtcagcacggttccgaa |
| | | cgccatggaaaccgccccccgccaggcccgctgcgacgccgacaggatcta |
| | | gcgctgcgtttggtgtcaacaccaacagcgccacgcccgcagttccgcaa |
| | | atagcccccaggaccgccatcaatcgtatcgggctacctagcagagcggc |
| | | agagatgaacacgaccatcagcggctgcacagcgcctaccgtcgccgcga |
| | | ccccgcccggcaggcggtagaccgaaataaacaacaagctccagaatagc |
| | | gaaatattaagtgcgccgaggatgaagatgcgcatccaccagattcccgt |
| | | tggaatctgtcggacgatcatcacgagcaataaacccgccggcaacgccc |
| | | gcagcagcataccggcgacccctcggcctcgctgttcgggctccacgaaa |
| | | acgccggacagatgcgccttgtgagcgtccttggggccgtcctcctgttt |
| | | gaagaccgacagcccaatgatctcgccgtcgatgtaggcgccgaatgcca |
| | | cggcatctcgcaaccgttcagcgaacgcctccatgggcttttctcctcg |
| | | tgctcgtaaacggacccgaacatctctggagctttcttcagggccgacaa |
| | | tcggatctcgcggaaatcctgcacgtcggccgctccaagccgtcgaatct |
| | | gagccttaatcacaattgtcaattttaatcctctgtttatcggcagttcg |
| | | tagagcgcgccgtgcgtcccgagcgatactgagcgaagcaagtgcgtcga |
| | | gcagtgcccgcttgttcctgaaatgccagtaaagcgctggctgctgaacc |
| | | cccagccggaactgaccccacaaggccctagcgtttgcaatgcaccaggt |
| | | catcattgacccaggcgtgttccaccaggccgctgcctcgcaactcttcg |
| | | caggcttcgccgacctgctcgcgccacttcttcacgcgggtggaatccga |
| | | tccgcacatgaggcggaaggtttccagcttgagcgggtacggctcccggt |
| | | gcgagctgaaatagtcgaacatccgtcgggccgtcggcgacagcttgcgg |
| | | tacttctcccatatgaatttcgtgtagtggtcgccagcaaacagcacgac |
| | | gatttcctcgtcgatcaggacctggcaacgggacgttttcttgccacggt |
| | | ccaggacgcggaagcggtgcagcagcgacaccgattccaggtgcccaacg |
| | | cggtcggacgtgaagcccatcgccgtcgcctgtaggcgcgacaggcattc |
| | | ctcggccttcgtgtaataccggccattgatcgaccagcccaggtcctggc |
| | | aaagctcgtagaacgtgaaggtgatcggctcgccgatagggtgcgcttc |
| | | gcgtactccaacacctgctgccacaccagttcgtcatcgtcggcccgcag |
| | | ctcgacgccggtgtaggtgatcttcacgtccttgttgacgtggaaatga |
| | | ccttgttttgcagcgcctcgcgcgggattttcttgttgcgcgtggtgaac |
| | | agggcagagcgggccgtgtcgtttggcatcgctcgcatcgtgtccggcca |
| | | cggcgcaatatcgaacaaggaaagctgcatttccttgatctgctgcttcg |
| | | tgtgtttcagcaacgcggcctgcttggcctcgctgacctgttttgccagg |
| | | tcctcgccggcggttttcgcttcttggtcgtcatagttcctcgcgtgtc |
| | | gatggtcatcgacttcgccaaacctgccgcctcctgttcgagacgacgcg |
| | | aacgctccacgcggccgatggcgcgggcagggcaggggagccagttgc |
| | | acgctgtcgcgctcgatcttggccgtagcttgctggaccatcgagccgac |
| | | ggactggaaggtttcgcggggcgcacgcatgacggtgcggcttgcgatgg |
| | | tttcggcatcctcggcggaaaaccccgcgtcgatcagttcttgcctgtat |
| | | gccttccggtcaaacgtccgattcattcaccctccttgcgggattgcccc |
| | | gactcacgccggggcaatgtgcccttattcctgatttgacccgcctggtg |
| | | ccttggtgtccagataatccaccttatcggcaatgaagtcggtcccgtag |
| | | accgtctggccgtccttctcgtacttggtattccgaatcttgccctgcac |
| | | gaataccagcgaccccttgcccaaatacttgccgtgggcctcggcctgag |
| | | agccaaaacacttgatgcggaagaagtcggtgcgctcctgcttgtcgccg |
| | | gcatcgttgcgccacatctaggtactaaaacaattcatccagtaaaatat |
| | | aatattttattttctcccaatcaggcttgatccccagtaagtcaaaaaat |
| | | agctcgacatactgttcttccccgatatcctccctgatcgaccggacgca |
| | | gaaggcaatgtcataccacttgtccgcctgccgcttctcccaagatcaa |
| | | taaagccacttactttgccatcttttcacaaagatgttgctgtctcccagg |
| | | tcgccgtgggaaaagacaagttcctcttcgggcttttccgtcttttaaaaa |
| | | atcatacagctcgcgcggatctttaaatggagtgtcttcttcccagtttt |
| | | cgcaatccacatcggccagatcgttattcagtaagtaatccaattcggct |
| | | aagcggctgtctaagctattcgtatagggacaatccgatatgtcgatgga |
| | | gtgaaagagcctgatgcactccgcatacagctcgataatcttttcagggc |
| | | tttgttcatcttcatactcttccgagcaaaggacgccatcggcctcactc |

TABLE 22-continued

Psilocybin expression vector sequences.

| SEQ ID NO. | Name | Sequence |
|---|---|---|
| | | atgagcagattgctccagccatcatgccgttcaaagtgcaggacctttgg
aacaggcagctttccttccagccatagcatcatgtcctttccccgttcca
catcataggtggtcccttataccggctgtccgtcattttttaaatataagg
ttttcattttctcccaccagcttatataccttagcaggagacattccttc
cgtatcttttacgcagcggtatttttcgatcagttttttcaattccggtg
atattctcattttagccatttattatttccttcctcttttctacagtatt
taaagatacccccaagaagctaattataacaagacgaactccaattcactg
ttccttgcattctaaaaccttaaataccagaaaacagcttttttcaaagtt
gttttcaaagttggcgtataacatagtatcgacggagccgattttgaaac
cacaattatgggtgatgctgccaacttactgatttagtgtatgatggtgt
ttttgaggtgctccagtggcttctgtgtctatcagctgtccctcctgttc
agctactgacggggtggtgcgtaacggcaaaagcaccgccggacatcagc
gctatctctgctctcactgccgtaaaacatggcaactgcagttcacttac
accgcttctcaacccggtacgcaccagaaaatcattgatatggccatgaa
tggcgttggatgccgggcaacagcccgcattatgggcgttggcctcaaca
cgattttacgtcacttaaaaaactcaggccgcagtcggtaacctcgcgca
tacagccgggcagtgacgtcatcgtctgcgcggaaatggacgaacagtgg
ggctatgtcggggctaaatcgcgccagcgctggctgttttacgcgtatga
cagtctccggaagacggttgttgcgcacgtattcggtgaacgcactatgg
cgacgctggggcgtcttatgagcctgctgtcacccttgacgtggtgata
tggatgacggatggctggccgctgtatgaatcccgcctgaagggaaagct
gcacgtaatcagcaagcgatatacgcagcgaattgagcggcataacctga
atctgaggcagcacctggcacggctgggacggaagtcgctgtcgttctca
aaatcggtggagctgcatgacaaagtcatcgggcattatctgaacataaa
acactatcaataagttggagtcattacccaattatgatagaatttacaag
ctataaggttattgtcctgggtttcaagcattagtccatgcaagtttta
tgctttgcccattctatagatatattgataagcgcgctgcctatgccttg
cccccctgaaatccttacatacggcgatatcttctatataaaagatatatt
atcttatcagtattgtcaatatattcaaggcaatctgcctcctcatcctc
ttcatcctcttcgtcttggtagcttttttaaatatggcgcttcatagagta
attctgtaaaggtccaattctcgttttcataccctcggtataatcttacct
atcacctcaaatggttcgctgggttttatcgcaccccgaacacgagcacg
gcacccgcgaccactatgccaagaatgcccaaggtaaaaattgccggccc
cgccatgaagtccgtgaatgccccgacggccgaagtgaagggcaggccgc
cacccaggccgcgccctcactgcccggcacctggtcgctgaatgtcgat
gccagcacctgcggcacgtcaatgcttccgggcgtcgcgctcgggctgat
cgcccatcccgttactgccccgatcccggcaatggcaaggactgccagcg
ctgccatttttggggtgaggccgttcgcggccgaggggcgcagccctgg
ggggatgggaggcccgcgttagcgggccgggagggttcgagaaggggggg
caccccccttcggcgtgcgcggtcacgcgcacagggcgcagccctggtta
aaaacaaggtttataaatattggttttaaaagcaggttaaaagacaggtta
gcggtggccgaaaaacgggcggaaaccccttgcaaatgctggattttctgc
ctgtggacagcccctcaaatgtcaataggtgcgccctcatctgtcagca
ctctgcccctcaagtgtcaaggatcgcgcccctcatctgtcagtagtcgc
gcccctcaagtgtcaataccgcagggcacttatcccccaggcttgtccaca
tcatctgtgggaaactcgcgtaaaatcaggcgttttcgccgatttgcgag
gctggccagctccacgtcgccggccgaaatcgagcctgcccctcatctgt
caacgccgcgcgggtgagtcggcccctcaagtgtcaacgtccgcccctc
atctgtcagtgagggccaagttttccgcgaggtatccacaacgccggcgg
ccgcggtgtctcgcacacggcttcgacggcgtttctggcgcgtttgcagg
gccatagacggccgccagcccagcggcgagggcaaccagcccgg |
| 105 | pGHGWY:Cc
DED1promoter_
intron:GW
cassette_YFP | AGATCTCTAATTCCGGGGATCGGAAATCCAGAAGCCCGAGAGGTTGCCGC
CTTTCGGGCTTTTTCTTTTTCAAAAAAAAAAATTTATAAAACGATCTGTT
GCGGCCGGCCGCCGGGTTGTGGGCAAAGGCGCTGGCGCTCGACGGTGGGC
AACCGCTTGCGGTTGTCCACGGGCGGAGCCGGTGCGCGTAGCGCATTGTC
CACAAGCCAAGGGCGACCAATAATTGATATATATATTCATAATTGAAAAG
CTAATTGAACATACTACTTGCTGTAACTACTTGCCGGAGCGAGGGGTGTT
TGCAAGCTGTTGATCTGAAAGGGCTATTAGCGTTCTCACGTGCCTTTTG
ATTAGCGATTTCACGTGACCTTATTAGCGATTTCACGTACTCCGATTAGC
GATTTCACGTACCCTGATTAGCGATTTCACGTGGATAGTTTTTGGAGCGG
GCCGGAAAGCCCCGTGAATCAAGGCTTTGCGGGGCATTAGCGGTTTCACG
TGGATAACTACCCTCTATCCACAGGCTTCCGGGGATAAAAAAGCCCGCTC
GACGGCGGGCTGTTGGATGGGGATCGCCTGAATCGCCCCATCATCCAGCC
AGAAAGTGAGGGAGCCACGGTTGATGAGAGCTTTGTTGTAGGTGGACCAG
TTGGTGATTTTGAACTTTTGCTTTGCCACGGAACGGTCTGCGTTGTCGGG
AAGATGCGTGATCTGATCCTTCAACTCAGCAAAAGTTCGATTTATTCAAC
AAAGCCACGTTGTGTCTCAAAATCTCTGATGTTACATTGCACAAGATAAA
AATATATCATCATGAACAATAAAACTGTCTGCTTACATAAACAGTAATAC
AAGGGGTGTTATGAGCCATATTCAACGGGAAACGTCTTGCTCAAGGCCGC
GATTAAATTCCAACATGGATGCTGATTTATATGGGTATAAATGGGCTCGC
GATAATGTCGGGCAATCAGGTGCGACAATCTACCGATTGTATGGGAAGCC
CGATGCGCCAGAGTTGTTTCTGAAACATGGCAAAGGTAGCGTTGCCAATG
TTGTTACAGATGAGATGGTCAGACTAAACTGGCTGACGGAATTTATGCCT |

TABLE 22-continued

Psilocybin expression vector sequences.

| SEQ ID NO. | Name | Sequence |
|---|---|---|
| | | CTTCCGACCATCAAGCATTTTATCCGTACTCCTGATGATGCATGGTTACT
CACCACTGCGATCCCAGGGAAAACAGCATTCCAGGTATTAGAAGAATATC
CTGATTCAGGTGAAAATATTGTTGATGCGCTGGCAGTGTTCCTGCGCCGG
TTGCATTCGATTCCTGTTTGTAATTGTCCTTTTAACAGCGATCGCGTATT
TCGTCTCGCTCAGGCGCAATCACGAATGAATAACGGTTTGGTTGATGCGA
GTGATTTTGATGACGAGCGTAATGGCTGGCCTGTTGAACAAGTCTGGAAA
GAAATGCATAAACTTTTGCCATTCTCACCGGATTCAGTCGTCACTCATGG
TGATTTCTCACTTGATAACCTTATTTTTGACGAGGGGAAATTAATAGGTT
GTATTGATGTTGGACGAGTCGGAATCGCAGACCGATACCAGGATCTTGCC
ATCCTATGGAACTGCCTCGGTGAGTTTTCTCCTTCATTACAGAAACGGCT
TTTTCAAAAATATGGTATTGATAATCCTGATATGAATAAATTGCAGTTTC
ATTTGATGCTCGATGAGTTTTTCTAATCACTAGACCAATGTTACACATAT
ATACTTTAGATTGATTTAAAACTTCATTTTTAATTTAAAAGGATCTAGGT
GAAGATCCTTTTTGATAATCTCATGACCAAAATCCCTTAACGTGAGTTTT
CGTTCCACTGAGCGTCAGACCCCGTAGAAAAGATCAAAGGATCTTCTTGA
GATCCTTTTTTTCTGCGCGTAATCTGCTGCTTGCAAACAAAAAAACCACC
GCTACCAGCGGTGGTTTGTTTGCCGGATCAAGAGCTACCAACTCTTCTTC
CGAAGGTAACTGGCTTCAGCAGAGCGCAGATACCAAATACTGTTCTTCTA
GTGTAGCCGTAGTTAGGCCACCACTTCAAGAACTCTGTAGCACCGCCTAC
ATACCTCGCTCTGCTAATCCTGTTACCAGTGGCTGCTGCCAGTGGCGATA
AGTCGTGTCTTACCGGGTTGGACTCAAGACGATAGTTACCGGATAAGGCG
CAGCGGTCGGGCTGAACGGGGGGTTCGTGCACACAGCCCAGCTTGGAGCG
AACGACCTACACCGAACTGAGATACCTACAGCGTGAGCTATGAGAAAGCG
CCACGCTTCCCGAAGGGAGAAAGGCGGACAGGTATCCGGTAAGCGGCAGG
GTCGGAACAGGAGAGCGCACGAGGGAGCTTCCAGGGGGAAACGCCTGGTA
TCTTTATAGTCCTGTCGGGTTTCGCCACCTCTGACTTGAGCGTCGATTTT
TGTGATGCTCGTCAGGGGGCGGAGCCTATGGAAAAACGCCAGCAACGCG
GCCTTTTTACGGTTCCTGGCCTTTTGCTGGCCTTTTGCTCACATGAGATC
TCAAACAAACACATACAGCGACTTAGTTTACCCGCCAATATATCCTGTCA
AGGATCGTACCCCTACTCCAAAAATGTCAAAGATACAGTCTCAGAAGACC
AAAGGGCTATTGAGACTTTTCAACAAAGGGTAATTTCGGGAAACCTCCTC
GGATTCCATTGCCCAGCTATCTGTCACTTCATCGAAAGGACAGTAGAAAA
GGAAGGTGGCTCCTACAAATGCCATCATTGCGATAAAGGAAAGGCTATCA
TTCAAGATGCCTCTGCCGACAGTGGTCCCAAAGATGGACCCCCACCCACG
AGGAGCATCGTGGAAAAAGAAGACGTTCCAACCACGTCTTCAAAGCAAGT
GGATTGATGTGACATCTCCACTGACGTAAGGGATGACGCACAATCCCACT
ATCCTTCGCAAGACCCTTCCTCTATATAAGGAAGTTCATTTCATTTGGAG
AGGACAGCCCAAGCTGATCCCTATGAAAAAGCCTGAACTCACCGCGACGT
CTGTCGAGAAGTTTCTGATCGAAAAGTTCGACAGCGTCTCCGACCTGATG
CAGCTCTCGGAGGGCGAAGAATCTCGTGCTTTCAGCTTCGATGTAGGAGG
GCGTGGATATGTCCTGCGGGTAAATAGCTGCGCCGATGGTTTCTACAAAG
ATCGTTATGTTTATCGGCACTTTGCATCGGCCGCGCTCCCGATTCCGGAA
GTGCTTGACATTGGGGAGTTCAGCGAGAGCCTGACCTATTGCATCTCCCG
CCGTGCACAGGGTGTCACGTTGCAAGACCTGCCTGAAACCGAACTGCCCG
CTGTTCTTCAGCCGGTCGCGGAGGCTATGGATGCGATCGCTGCGGCCGAT
CTTAGCCAGACGAGCGGGTTCGGCCCATTCGGACCGCAAGGAATCGGTCA
ATACACTACATGGCGTGATTTCATATGCGCGATTGCTGATCCCCATGTGT
ATCACTGGCAAACTGTGATGGACGACACCGTCAGTGCGTCCGTCGCGCAG
GCTCTCGATGAGCTGATGCTTTGGGCCGAGGACTGCCCCGAAGTCCGGCA
CCTCGTGCACGCGGATTTCGGCTCCAACAATGTCCTGACGGACAATGGCC
GCATAACAGCGGTCATTGACTGGAGCGAGGCGATGTTCGGGGATTCCCAA
TACGAGGTCGCCAACATCTTCTTCTGGAGGCCGTGGTTGGCTTGTATGGA
GCAGCAGACGCGCTACTTCGAGCGGAGGCATCCGGAGCTTGCAGGATCGC
CACGCCTCCGGGCGTATATGCTCCGCATTGGTCTTGACCAACTCTATCAG
AGCTTGGTTGACGGCAATTTCGATGATGCAGCTTGGGCGCAGGGTCGATG
CGACGCAATCGTCCGATCCGGAGCCGGGACTGTCGGGCGTACACAAATCG
CCCGCAGAAGCGCGGCCGTCTGGACCGATGGCTGTGTAGAAGTACTCGCC
GATAGTGGAAACCGACGCCCCAGCACTCGTCCGAGGGCAAAGGAATAGAG
TAGATGCCGACCGAACAAGAGCTGATTTCGAGAACGCCTCAGCCAGCAAC
TCGCGCGAGCCTAGCAAGGCAAATGCGAGAGAACGGCCTTACGCTTGGTG
GCACAGTTCTCGTCCACAGTTCGCTAAGCTCGCTCGGCTGGTCGCGGGAG
AATTAATTCGGTACGCTGAAATCACCAGTCTCTCTACAAATCTATCTC
TCTCTATTTTCTCCATAAATAATGTGTGAGTAGTTTCCCGATAAGGGAAA
TTAGGGTTCTTATAGGGTTTCGCTCATGTGTTGAGCATATAAGAAACCCT
TAGTATGTATTTGTATTTGTAAAATACTTCTATCAATAAAATTTCTAATT
CCTAAAACCAAAATCCAGTACTAAAATCCAGATCGATCCTTCATGTTCTT
TCCTGCGTTATCCCTGATTCTGTGGATAACCGTATTACCGCCTTTGAGT
GAGCTGATACCGCTCGCCGCAGCCGAACGACCGAGCGCAGCGAGTCAGTG
AGCGAGGAAGCGGAAGAGCGCCCAATACGCAAACCGCCTCTCCCCGCGCG
TTGGCCGATTCATTAATGCAGCTGGCACGACAGGTTTCCCGACTGGAAAG
CGGGCAGTGAGCGCAACGCAATTAATGTGAGTTAGCTCACTCATTAGGCA
CCCCAGGCTTTACACTTTATGCTTCCGGCTCGTATGTTGTGTGGAATTG
TGAGCGGATAACAATTTCACACAGGAAACAGCTATGACCATGATTACGCC
AAGCTCGGAATTAACCCTCACTAAAGGGAACAAAAGCTGGAGCTCTGGTC |

TABLE 22-continued

Psilocybin expression vector sequences.

| SEQ ID NO. | Name | Sequence |
|---|---|---|
| | | CCGCAGGGGCGGCGGCTGAAACATCTGCACAAGCTACTGCCACGGCGCAG
AGTAGTGGACGGGCGACGCCGCAGGCGACTGCGAACCCCTCTAGTGCAGC
TTCGCAACAATCTGTCGCTGCTGCGGCAGCGACGCCATCTTCTGCGAGGG
CGAGTCCGATGCCTGCTATGCACGCCAACAGAATCCCACTCAGTCGCAA
CAAGCCCAGCAAGCGAATGCGGCCATACTTCAAGCTGCGATTCAACAACA
ACAACTACAGCGACAACAGCAACAATACCAGCGCACGTTGACCCCCATTC
AGCCACAGAAGACGAACTCTCAAGGAGGGCAGGTGCAGATGCAGGTTCAG
CCGCAATTGGCCGCAAATGGACAATATACGTTCACGACGCCGTTCAATGC
TGCCGCATTGCGAGCCGCAACGCCCTTGACCGCTAGTCAGCAAGCTGCTG
CTCAACGGATGGCTGCTGCCCAAGCAAATGCAGCTAAAATGAGCGCGGGG
ACCCCTGCACAGAATGCAGGCAGTAACATTCACGTACAGCCGTCACCGCA
ACAAGCCCAGGCTCAAATCCAGGTACAGCAGCAGCAGACGCTTCAGGTCC
CGCAACAGCAACAGGCGAGGACACCACAAATGCAAACGCAGCAGCTACGG
ACGCCTCAAATTCAGGCTCAGCAATTACGGACGCCACAGATGCAAACGCA
ACAGCTTCAGCGAACGCCTCAGATGCAGACGCAACAACTTCAACCGACGC
CGCAGATGCAGCCTCAGCAGCTCCAGTCTCAAATGGGGCAGATGCAACGC
CAGCCGACTCCTCAGCAACATACGCCTCAGCAACAACATGCTCAACTTCA
GCCTGTGCAGGCTCAGCAGTTAGCGATGGCCCAGCAGCAACAGCAACAGC
AGCAAATGCAGGCTCAAATTCAGCAGCAACAACCACAACAAGCGCATCTG
ACTCCGCAACAGTATCAGCAGTATCAGATGTATAGCAATTATTATCAAGC
TGCGGCGGCAATGCAACAACACGGGGGACAGAGACTGACTCCGCAACAAC
AACAGGCAATTTGGAACGCGCAGTTCCAGCGTGCTGCTGCTGCTGCTGGT
ATGCAGGGGCAGCATGGCGGGGTACCTATGAACCAGGTACAACAGGCTGC
GCTGGCCGCACACATAGCGAAACAGCAGCAACAACAGCAACAGCATCAAG
GTCAAGGTCCACGGTGAATGGGTTTAGCTTCGTAGATAGTGTATTAGTAT
TTTGTAATGGACATTGGGATTGGGTGAAGACAAACCCGAGAACGTCATCT
TTGTGGAGTGTTTGTTCGGATTTGGTGTGAGGCCGTGCAAGCTTAGTCAG
CAGTTAGTGGAAAAGGTGGAGGTAGAAAGAGGGCAAGGGAAGTTTTCGTC
TCCTTTCTGATCTGGTACCACCATCATCACCCCAGCAAAACTCTCTACTC
TCTTAGACCTTCACTTTATCCTTCACTTTTATTCTTTTTCAACTCTTTTC
GTTTCTCAAGTTCTACTCCCAAAGTCGCTCGTTTCTTTCGAATTTCACGA
AAGACTGCACAAAAAGACGTATCTTTGCTAGCCCTGCAAGCATCGACCAC
CGATATCCACAGCGATTCAAGAACGATTCGAGTTCAACAAATCTTCAACT
AATgtaattctctttcttttgggataagttgaaacccgaacgaggaacta
atctttcactcggtgtagAAGCTTATCGATACCGTCGACCTCGAGGGGGG
GCCCGGTACCCACCGGATCCACAAGTTTGTACAAAAAAGCTGAACGAGAA
ACGTAAAATGATATAAATATCAATATATTAAATTAGATTTTGCATAAAAA
ACAGACTACATAATACTGTAAAACACAACATATCCAGTCACTATGGCGGC
CGCATTAGGCACCCCAGGCTTTACACTTTATGCTTCCGGCTCGTATAATG
TGTGGATTTTGAGTTAGGATCCGGCGAGATTTTCAGGAGCTAAGGAAGCT
AAAATGGAGAAAAAAATCACTGGATATACCACCGTTGATATATCCCAATG
GCATCGTAAAGAACATTTTGAGGCATTTCAGTCAGTTGCTCAATGTACCT
ATAACCAGACCGTTCAGCTGGATATTACGGCCTTTTTAAAGACCGTAAAG
AAAAATAAGCACAAGTTTTATCCGGCCTTTATTCACATTCTTGCCCGCCT
GATGAATGCTCATCCGGAATTCCGTATGGCAATGAAAGACGGTGAGCTGG
TGATATGGGATAGTGTTCACCCTTGTTACACCGTTTTCCATGAGCAAACT
GAAACGTTTTCATCGCTCTGGAGTGAATACCACGACGATTTCCGGCAGTT
TCTACACATATATTCGCAAGATGTGGCGTGTTACGGTGAAAACCTGGCCT
ATTTCCCTAAAGGGTTTATTGAGAATATGTTTTCGTCTCAGCCAATCCC
TGGGTGAGTTTCACCAGTTTTGATTTAAACGTGGCCAATATGGACAACTT
CTTCGCCCCCGTTTTCACCATGGGCAAATATTATACGCAAGGCGACAAGG
TGCTGATGCCGCTGGCGATTCAGGTTCATCATGCCGTCTGTGATGGCTTC
CATGTCGGCAGAATGCTTAATGAATTACAACAGTACTGCGATGAGTGGCA
GGGCGGGGCGTAAACGCGTGGATCCGGCTTACTAAAAGCCAGATAACAGT
ATGCGTATTTGCGCGCTGATTTTTGCGGTATAAGAATATATACTGATATG
TATACCCGAAGTATGTCAAAAAGAGGTGTGCTATGAAGCAGCGTATTACA
GTGACAGTTGACAGCGACAGCTATCAGTTGCTCAAGGCATATATGATGTC
AATATCTCCGGTCTGGTAAGCACAACCATGCAGAATGAAGCCCGTCGTCT
GCGTGCCGAACGCTGGAAAGCGGAAAATCAGGAAGGGATGGCTGAGGTCG
CCCGGTTTATTGAAATGAACGGCTCTTTTGCTGACGAGAACAGGGACTGG
TGAAATGCAGTTTAAGGTTTACACCTATAAAAGAGAGCCGTTATCGTC
TGTTTGTGGATGTACAGAGTGATATTATTGACACGCCCGGGCGACGGATG
GTGATCCCCCTGGCCAGTGCACGTCTGCTGTCAGATAAAGTCTCCCGTGA
ACTTTACCCGGTGGTGCATATCGGGGATGAAAGCTGGCGCATGATGACCA
CCGATATGGCCAGTGTGCCGGTCTCCGTTATCGGGGAAGAAGTGGCTGAT
CTCAGCCACCGCGAAAATGACATCAAAAACGCCATTAACCTGATGTTCTG
GGGAATATAAATGTCAGGCTCCCTTATACACAGCCAGTCTGCAGGTCGAC
CATAGTGACTGGATATGTTGTGTTTTACAGTATTATGTAGTCTGTTTTTT
ATGCAAAATCTAATTTAATATATTGATATTTATATCATTTTACGTTTCTC
GTTCAGCTTTCTTGTACAAAGTGGTGCTCGAGATGGTGAGCAAGGGCGAG
GAGCTGTTCACCGGGGTGGTGCCCATCCTGGTCGAGCTGGACGGCGACGT
AAACGGCCACAAGTTCAGCGTGTCCGGCGAGGGCGAGGGCGATGCCACCT
ACGGCAAGCTGACCCTGAAGCTGATCTGCACCACCGGCAAGCTGCCCGTG
CCCTGGCCCACCCTCGTGACCACCCTGGGCTACGGCCTGCAGTGCTTCGC |

TABLE 22-continued

Psilocybin expression vector sequences.

| SEQ ID NO. | Name | Sequence |
|---|---|---|
| | | CCGCTACCCCGACCACATGAAGCAGCACGACTTCTTCAAGTCCGCCATGC CCGAAGGCTACGTCCAGGAGCGCACCATCTTCTTCAAGGACGACGGCAAC TACAAGACCCGCGCCGAGGTGAAGTTCGAGGGCGACACCCTGGTGAACCG CATCGAGCTGAAGGGCATCGACTTCAAGGAGGACGGCAACATCCTGGGGC ACAAGCTGGAGTACAACTACAACAGCCACAACGTCTATATCACCGCCGAC AAGCAGAAGAACGGCATCAAGGCCAACTTCAAGATCCGCCACAACATCGA GGACGGCGGCGTGCAGCTCGCCGACCACTACCAGCAGAACACCCCCATCG GCGACGGCCCCGTGCTGCTGCCCGACAACCACTACCTGAGCTACCAGTCC GCCCTGAGCAAAGACCCCAACGAGAAGCGCGATCACATGGTCCTGCTGGA GTTCGTGACCGCCGCCGGGATCACTCTCGGCATGGACGAGCTGTACAAGT AAGTCGACCTGCAGGCATGCGCTGAAATCACCAGTCTCTCTCTACAAATC TATCTCTCTCTATAATAATGTGTGAGTAGTTCCCAGATAAGGGAATTAGG GTTCTTATAGGGTTTCGCTCATGTGTTGAGCATATAAGAAACCCTTAGTA TGTATTTGTATTTGTAAAATACTTCTATCAATAAAATTTCTAATTCCTAA AACCAAAATCCAGTGGGTACCCAATTCGCCCTATAGTGAGTCGTATTACA ATTCACTGGCCGTCGTTTTACAACGTCGTGACTGGGAAAACCCTGGCGTT ACCCAACTTAATCGCCTTGCAGCACATCCCCCTTTCGCCAGCTGGCGTAA TAGCGAAGAGGCCCGCACCGATCGCCCTTCCCAACAGTTGCGCAGCCTGA ATGGCGAATGGCGCGAAATTGTAAACGTTAATGTTAACGTTACACCACAA TATATCCTGCCA |
| 106 | pGHGWY: GPDpromoter_ intron:GW cassette:YFP | AGATCTCTAATTCCGGGGATCGGAAATCCAGAAGCCCGAGAGGTTGCCGC CTTTCGGGCTTTTTCTTTTTCAAAAAAAAAAATTTATAAAACGATCTGTT GCGGCCGGCCGCCGGGTTGTGGGCAAAGGCGCTGGCGCTCGACGGTGGGC AACCGCTTGCGGTTGTCCACGGGCGGAGCCGGTGCGCGTAGCGCATTGTC CACAAGCCAAGGGCGACCAATAATTGATATATATATTCATAATTGAAAAG CTAATTGAACATACTACTTGCTGTAACTACTTGCCGGAGCGAGGGGTGTT TGCAAGCTGTTGATCTGAAAGGGCTATTAGCGTTCTCACGTGCCTTTTTG ATTAGCGATTTCACGTGACCTTATTAGCGATTTCACGTACTCCGATTAGC GATTTCACGTACCCTGATTAGCGATTTCACGTGGATAGTTTTTGGAGCGG GCCGGAAAGCCCCGTGAATCAAGGCTTTGCGGGGCATTAGCGGTTTCACG TGGATAACTACCCTCTATCCGACAGGCTTCCGGGGATAAAAAAGCCCGCTC GACGGCGGGCTGTTGGATGGGGATCGCCTGAATCGCCCCATCATCCAGCC AGAAAGTGAGGGAGCCACGGTTGATGAGAGCTTTGTTGTAGGTGGACCAG TTGGTGATTTTGAACTTTTGCTTTGCCACGGAACGGTCTGCGTTGTCGGG AAGATGCGTGATCTGATCCTTCAACTCAGCAAAAGTTCGATTTATTCAAC AAAGCCACGTTGTGTCTCAAAATCTCTGATGTTACATTGCACAAGATAAA AATATATCATCATGAACAATAAAACTGTCTGCTTACATAAACAGTAATAC AAGGGGTGTTATGAGCCATATTCAACGGGAAACGTCTTGCTCAAGGCCGC GATTAAATTCCAACATGGATGCTGATTTATATGGGTATAAATGGGCTCGC GATAATGTCGGGCAATCAGGTGCGACAATCTACCGATTGTATGGGAAGCC CGATGCGCCAGAGTTGTTTCTGAAACATGGCAAAGGTAGCGTTGCCAATG TTGTTACAGATGAGATGGTCAGACTAAACTGGCTGACGGAATTTATGCCT CTTCCGACCATCAAGCATTTTATCCGTACTCCTGATGATGCATGGTTACT CACCACTGCGATCCCAGGGAAAACAGCATTCCAGGTATTAGAAGAATATC CTGATTCAGGTGAAAATATTGTTGATGCGCTGGCAGTGTTCCTGCGCCGG TTGCATTCGATTCCTGTTTGTAATTGTCCTTTTAACAGCGATCGCGTATT TCGTCTCGCTCAGGCGCAATCACGAATGAATAACGGTTTGGTTGATGCGA GTGATTTTGATGACGAGCGTAATGGCTGGCCTGTTGAACAAGTCTGGAAA GAAATGCATAAACTTTTGCCATTCTCACCGGATTCAGTCGTCACTCATGG TGATTTCTCACTTGATAACCTTATTTTTGACGAGGGGAAATTAATAGGTT GTATTGATGTTGGACGAGTCGGAATCGCAGACCGATACCAGGATCTTGCC ATCCTATGGAACTGCCTCGGTGAGTTTTCTCCTTCATTACAGAAACGGCT TTTTCAAAAATATGGTATTGATAATCCTGATATGAATAAATTGCAGTTTC ATTTGATGCTCGATGAGTTTTTCTAATCACTAGACCAATGTTACACATAT ATACTTTAGATTGATTTAAAACTTCATTTTTAATTTAAAAGGATCTAGGT GAAGATCCTTTTTGATAATCTCATGACCAAAATCCCTTAACGTGAGTTTT CGTTCCACTGAGCGTCAGACCCCGTAGAAAAGATCAAAGGATCTTCTTGA GATCCTTTTTTTCTGCGCGTAATCTGCTGCTTGCAAACAAAAAAACCACC GCTACCAGCGGTGGTTTGTTTGCCGGATCAAGAGCTACCAACTCTTCTTC CGAAGGTAACTGGCTTCAGCAGAGCGCAGATACCAAATACTGTTCTTCTA GTGTAGCCGTAGTTAGGCCACCACTTCAAGAACTCTGTAGCACCGCCTAC ATACCTCGCTCTGCTAATCCTGTTACCAGTGGCTGCTGCCAGTGGCGATA AGTCGTGTCTTACCGGGTTGGACTCAAGACGATAGTTACCGGATAAGGCG CAGCGGTCGGGCTGAACGGGGGGTTCGTGCACACAGCCCAGCTTGGAGCG AACGACCTACACCGAACTGAGATACCTACAGCGTGAGCTATGAGAAAGCG CCACGCTTCCCGAAGGGAGAAAGGCGGACAGGTATCCGGTAAGCGGCAGG GTCGGAACAGGAGAGCGCACGAGGGAGCTTCCAGGGGGAAACGCCTGGTA TCTTTATAGTCCTGTCGGGTTTCGCCACCTCTGACTTGAGCGTCGATTTT TGTGATGCTCGTCAGGGGGCGGAGCCTATGGAAAAACGCCAGCAACGCG GCCTTTTTACGGTTCCTGGCCTTTTGCTGGCCTTTTGCTCACATGAGATC TCAAACAAACACATACAGCGACTTAGTTTACCCGCCAATATATCCTGTCA AGGATCGTACCCCTACTCCAAAAATGTCAAAGATACAGTCTCAGAAGACC AAAGGGCTATTGAGACTTTTCAACAAAGGGTAATTTCGGGAAACCTCCTC |

TABLE 22-continued

Psilocybin expression vector sequences.

| SEQ ID NO. | Name | Sequence |
|---|---|---|
| | | GGATTCCATTGCCCAGCTATCTGTCACTTCATCGAAAGGACAGTAGAAAA
GGAAGGTGGCTCCTACAAATGCCATCATTGCGATAAAGGAAAGGCTATCA
TTCAAGATGCCTCTGCCGACAGTGGTCCCAAAGATGGACCCCCACCCACG
AGGAGCATCGTGGAAAAAGAAGACGTTCCAACCACGTCTTCAAAGCAAGT
GGATTGATGTGACATCTCCACTGACGTAAGGGATGACGCACAATCCCACT
ATCCTTCGCAAGACCCTTCCTCTATATAAGGAAGTTCATTTCATTTGGAG
AGGACAGCCCAAGCTGATCCCTATGAAAAAGCCTGAACTCACCGCGACGT
CTGTCGAGAAGTTTCTGATCGAAAAGTTCGACAGCGTCTCCGACCTGATG
CAGCTCTCGGAGGGCGAAGAATCTCGTGCTTTCAGCTTCGATGTAGGAGG
GCGTGGATATGTCCTGCGGGTAAATAGCTGCGCCGATGGTTTCTACAAAG
ATCGTTATGTTTATCGGCACTTTGCATCGGCCGCGCTCCCGATTCCGGAA
GTGCTTGACATTGGGGAGTTCAGCGAGAGCCTGACCTATTGCATCTCCCG
CCGTGCACAGGGTGTCACGTTGCAAGACCTGCCTGAAACCGAACTGCCCG
CTGTTCTTCAGCCGGTCGCGGAGGCTATGGATGCGATCGCTGCGGCCGAT
CTTAGCCAGACGAGCGGGTTCGGCCCATTCGGACCGCAAGGAATCGGTCA
ATACACTACATGGCGTGATTTCATATGCGCGATTGCTGATCCCCATGTGT
ATCACTGGCAAACTGTGATGGACGACACCGTCAGTGCGTCCGTCGCGCAG
GCTCTCGATGAGCTGATGCTTTGGGCCGAGGACTGCCCCGAAGTCCGGCA
CCTCGTGCACGCGGATTTCGGCTCCAACAATGTCCTGACGGACAATGGCC
GCATAACAGCGGTCATTGACTGGAGCGAGGCGATGTTCGGGGATTCCCAA
TACGAGGTCGCCAACATCTTCTTCTGGAGGCCGTGGTTGGCTTGTATGGA
GCAGCAGACGCGCTACTTCGAGCGGAGGCATCCGGAGCTTGCAGGATCGC
CACGCCTCCGGGCGTATATGCTCCGCATTGGTCTTGACCAACTCTATCAG
AGCTTGGTTGACGGCAATTTCGATGATGCAGCTTGGGCGCAGGGTCGATG
CGACGCAATCGTCCGATCCGGAGCCGGGACTGTCGGGCGTACACAAATCG
CCCGCAGAAGCGCGGCCGTCTGGACCGATGGCTGTGTAGAAGTACTCGCC
GATAGTGGAAACCGACGCCCCAGCACTCGTCCGAGGGCAAAGGAATAGAG
TAGATGCCGACCGAACAAGAGCTGATTTCGAGAACGCCTCAGCCAGCAAC
TCGCGCGAGCCTAGCAAGGCAAATGCGAGAGAACGGCCTTACGCTTGGTG
GCACAGTTCTCGTCCACAGTTCGCTAAGCTCGCTCGGCTGGTCGCGGGAG
AATTAATTCGGTACGCTGAAATCACCAGTCTCTCTCTACAAATCTATCTC
TCTCTATTTTCTCCATAAATAATGTGTGAGTAGTTTCCCGATAAGGGAAA
TTAGGGTTCTTATAGGGTTTCGCTCATGTGTTGAGCATATAAGAAACCCT
TAGTATGTATTTGTATTTGTAAAATACTTCTATCAATAAAATTTCTAATT
CCTAAAACCAAAATCCAGTACTAAAATCCAGATCGATCCTTCATGTTCTT
TCCTGCGTTATCCCCTGATTCTGTGGATAACCGTATTACCGCCTTTGAGT
GAGCTGATACCGCTCGCCGCAGCCGAACGACCGAGCGCAGCGAGTCAGTG
AGCGAGGAAGCGGAAGAGCGCCCAATACGCAAACCGCCTCTCCCCGCGCG
TTGGCCGATTCATTAATGCAGCTGGCACGACAGGTTTCCCGACTGGAAAG
CGGGCAGTGAGCGCAACGCAATTAATGTGAGTTAGCTCACTCATTAGGCA
CCCCAGGCTTTACACTTTATGACTTCCGGCTCGTATGTTGTGTGGAATTG
TGAGCGGATAACAATTTCACACAGGAAACAGCTATGACCATGATTACGCC
AAGCTCGGAATTAACCCTCACTAAAGGGAACAAAAGCTGGAGCTCgaggt
ccgcaagtagattgaaagttcagtacgttttaacaatagagcattctcg
aggcttgcgtcattctgtgtcaggctagcagtttataagcgttgaggatc
tagagctgctgtttccgcgtctcgaatgttctcggtgtttaggggttagc
aatctgatatgataataatttgtgatgacatcgatagtacaaaaacccca
attccggtcacatccacctctccgttttctcccatctacacacaacaagc
ttatcgccgtaattctctttcttttgggataagttgaaacccgaacgagg
aactaatctttcactcggtgtagAAGCTTATCGATACCGTCGACCTCGAG
GGGGGGCCCGGTACCCACCGGATCCACAAGTTTGTACAAAAAAGCTGAAC
GAGAAACGTAAAATGATATAAATATCAATATATTAAATTAGATTTTGCAT
AAAAAACAGACTACATAATACTGTAAAACACAACATATCCAGTCACTATG
GCGGCCGCATTAGGCACCCCAGGCTTTACACTTTATGCTTCCGGCTCGTA
TAATGTGTGGATTTTGAGTTAGGATCCGGCGAGATTTTCAGGAGCTAAGG
AAGCTAAAATGGAGAAAAAAATCACTGGATATACCACCGTTGATATATCC
CAATGGCATCGTAAAGAACATTTTGAGGCATTTCAGTCAGTTGCTCAATG
TACCTATAACCAGACCGTTCAGCTGGATATTACGGCCTTTTTAAAGACCG
TAAAGAAAAATAAGCACAAGTTTTATCCGGCCTTTATTCACATTCTTGCC
CGCCTGATGAATGCTCATCCGGAATTCCGTATGGCAATGAAAGACGGTGA
GCTGGTGATATGGGATAGTGTTCACCCTTGTTACACCGTTTTCCATGAGC
AAACTGAAACGTTTTCATCGCTCTGGAGTGAATACCACGACGATTTCCGG
CAGTTTCTACACATATATTCGCAAGATGTGGCGTGTTACGGTGAAAACCT
GGCCTATTTCCCTAAAGGGTTTATTGAGAATATGTTTTCGTCTCAGCCA
ATCCCTGGGTGAGTTTCACCAGTTTTGATTTAAACGTGGCCAATATGGAC
AACTTCTTCGCCCCCGTTTTCACCATGGGCAAATATTATACGCAAGGCGA
CAAGGTGCTGATGCCGCTGGCGATTCAGGTTCATCATGCCGTCTGTGATG
GCTTCCATGTCGGCAGAATGCTTAATGAATTACAACAGTACTGCGATGAG
TGGCAGGGCGGGGCGTAAACGCGTGGATCCGGCTTACTAAAAGCCAGATA
ACAGTATGCGTATTTGCGCGCTGATTTTTGCGGTATAAGAATATATACTG
ATATGTATACCCGAAGTATGTCAAAAAGAGGTGTGCTATGAAGCAGCGTA
TTACAGTGACAGTTGACAGCGACAGCTATCAGTTGCTCAAGGCATATATG
ATGTCAATATCTCCGGTCTGGTAAGCACAACCATGCAGAATGAAGCCCGT
CGTCTGCGTGCCGAACGCTGGAAAGCGGAAAATCAGGAAGGGATGGCTGA |

TABLE 22-continued

Psilocybin expression vector sequences.

| SEQ ID NO. | Name | Sequence |
|---|---|---|
| | | GGTCGCCCGGTTTATTGAAATGAACGGCTCTTTTGCTGACGAGAACAGGG<br>ACTGGTGAAATGCAGTTTAAGGTTTACACCTATAAAAGAGAGAGCCGTTA<br>TCGTCTGTTTGTGGATGTACAGAGTGATATTATTGACACGCCCGGGCGAC<br>GGATGGTGATCCCCCTGGCCAGTGCACGTCTGCTGTCAGATAAAGTCTCC<br>CGTGAACTTTACCCGGTGGTGCATATCGGGGATGAAAGCTGGCGCATGAT<br>GACCACCGATATGGCCAGTGTGCCGGTCTCCGTTATCGGGGAAGAAGTGG<br>CTGATCTCAGCCACCGCGAAAATGACATCAAAAACGCCATTAACCTGATG<br>TTCTGGGGAATATAAATGTCAGGCTCCCTTATACACAGCCAGTCTGCAGG<br>TCGACCATAGTGACTGGATATGTTGTGTTTTACAGTATTATGTAGTCTGT<br>TTTTTATGCAAAATCTAATTTAATATATTGATATTTATATCATTTTACGT<br>TTCTCGTTCAGCTTTCTTGTACAAAGTGGTGCTCGAGATGGTGAGCAAGG<br>GCGAGGAGCTGTTCACCGGGGTGGTGCCCATCCTGGTCGAGCTGGACGGC<br>GACGTAAACGGCCACAAGTTCAGCGTGTCCGGCGAGGGCGAGGGCGATGC<br>CACCTACGGCAAGCTGACCCTGAAGCTGATCTGCACCACCGGCAAGCTGC<br>CCGTGCCCTGGCCCACCCTCGTGACCACCCTGGGCTACGGCCTGCAGTGC<br>TTCGCCCGCTACCCCGACCACATGAAGCAGCACGACTTCTTCAAGTCCGC<br>CATGCCCGAAGGCTACGTCCAGGAGCGCACCATCTTCTTCAAGGACGACG<br>GCAACTACAAGACCCGCGCCGAGGTGAAGTTCGAGGGCGACACCCTGGTG<br>AACCGCATCGAGCTGAAGGGCATCGACTTCAAGGAGGACGGCAACATCCT<br>GGGGCACAAGCTGGAGTACAACTACAACAGCCACAACGTCTATATCACCG<br>CCGACAAGCAGAAGAACGGCATCAAGGCCAACTTCAAGATCCGCCACAAC<br>ATCGAGGACGGCGGCGTGCAGCTCGCCGACCACTACCAGCAGAACACCCC<br>CATCGGCGACGGCCCCGTGCTGCTGCCCGACAACCACTACCTGAGCTACC<br>AGTCCGCCCTGAGCAAAGACCCCAACGAGAAGCGCGATCACATGGTCCTG<br>CTGGAGTTCGTGACCGCCGCCGGGATCACTCTCGGCATGGACGAGCTGTA<br>CAAGTAAGTCGACCTGCAGGCATGCGCTGAAATCACCAGTCTCTCTCTAC<br>AAATCTATCTCTCTCTATAATAATGTGTGAGTAGTTCCCAGATAAGGGAA<br>TTAGGGTTCTTATAGGGTTTCGCTCATGTGTTGAGCATATAAGAAACCCT<br>TAGTATGTATTTGTATTTGTAAAATACTTCTATCAATAAAATTTCTAATT<br>CCTAAAACCAAAATCCAGTGGGTACCCAATTCGCCCTATAGTGAGTCGTA<br>TTACAATTCACTGGCCGTCGTTTTACAACGTCGTGACTGGGAAAACCCTG<br>GCGTTACCCAACTTAATCGCCTTGCAGCACATCCCCCTTTCGCCAGCTGG<br>CGTAATAGCGAAGAGGCCCGCACCGATCGCCCTTCCCAACAGTTGCGCAG<br>CCTGAATGGCGAATGGCGCGAAATTGTAAACGTTAATGTTAACGTTACAC<br>CACAATATATCCTGCCA |
| 107 | >pCAMBIA1<br>300enhanced3<br>5SHygGPDpromo_<br>intron_<br>fuse_psiD_35S<br>term_Empyrean<br>Blue<br>vector | aattcgagctcggtacccggggatcctctagagaggtccgcaagtagatt<br>gaaagttcagtacgttttaacaatagagcattttcgaggcttgcgtcat<br>tctgtgtcaggctagcagtttataagcgttgaggatctagagctgctgtt<br>cccgcgtctcgaatgttctcggtgtttaggggttagcaatctgatatgat<br>aataatttgtgatgacatcgatagtacaaaaaccccaattccggtcacat<br>ccaccatctccgttttctcccatctacacacaacaagctcatcgccgttt<br>gtctctcgcttgcataccacccagcagctcactgatgtcgacttgtagat<br>gcaggtgatacccgcgtgcaactcggcagcaataagatcactatgtccta<br>ctcccgagtcttttagaaacatgggatggctctctgtcagcgatgcggtc<br>tacagcgagttcataggagagttggctacccgcgcttccaatcgaaatta<br>ctccaacgagttcggcctcatgcaacctatccaggaattcaaggctttca<br>ttgaaagcgacccggtggtgcaccaagaattttattgacatgttcgagggc<br>attcaggactctccaaggaattatcaggaactatgtaatatgttcaacga<br>tatctttcgcaaagctcccgtctacggagaccttggccctcccgttttata<br>tgattatggccaaattaatgaacacccgagcgggcttctctgcattcacg<br>agacaaaggttgaaccttcacttcaaaaaacttttcgatacctgggggatt<br>gttcctgtcttcgaaagattctcgaaatgttcttgtggccgaccagttcg<br>acgacagacattgcggctggttgaacgagcgggccttgtctgctatggtt<br>aaacattacaatggacgcgcatttgatgaagtcttcctctgcgataaaaa<br>tgccccatactacggcttcaactcttacgacgacttcttaatcgcagat<br>ttcgaaaccgagatatcgaccgacctgtagtcggtggagttaacaacacc<br>accctcatttctgctgcttgcgaatcacttttcctacaacgtctcttatga<br>cgtccagtctctcgacactttagttttcaaaggagagacttattcgctta<br>agcatttgctgaataatgaccctttcaccccacaattcgagcatgggagt<br>attctacaaggattcttgaacgtcaccgcttaccaccgatggcacgcacc<br>cgtcaatgggacaatcgtcaaaatcatcaacgttccaggtacctactttg<br>cgcaagcccgagcacgattggcgaccctatcccggataacgattacgac<br>ccacctccttaccttaagtctcttgtctacttctctaatattgccgcaag<br>gcaaattatgtttattgaagccgacaacaaggaaattggcctcatttcc<br>ttgtgttcatcggcatgaccgaaatctcgacatgtgaagccacggtgtcc<br>gaaggtcaacacgtcaatcgtggcgatgacttgggaatgttccatttcgg<br>tggttcttcgttcgcgcttggtctgaggaaggattgcagggcagagatcg<br>ttgaaaagttcaccgaacccggaacagtgatcagaatcaacgaagtcgtc<br>gctgctctaaaggcttagagtagatgccgaccggatctgtcgatcgacaa<br>gctcgagtttctccataataatgtgtgagtagttcccagataagggaatt<br>agggttcctataggggtttcgctcatgtgttgagcatataagaaacccta<br>gtatgtatttgtatttgtaaaatacttctatcaataaaatttctaattcc<br>taaaaccaaaatccagtactaaaatccagatcaagcttggcactggccgt |

TABLE 22-continued

Psilocybin expression vector sequences.

| SEQ ID NO. | Name | Sequence |
|---|---|---|
| | | cgttttacaacgtcgtgactgggaaaaccctggcgttacccaacttaatc gccttgcagcacatcccctttcgccagctggcgtaatagcgaagaggcc cgcaccgatcgcccttcccaacagttgcgcagcctgaatggcgaatgcta gagcagcttgagcttggatcagattgtcgtttcccgccttcagtttaaac tatcagtgtttgacaggatatattggcgggtaaacctaagagaaaagagc gtttattagaataacggatatttaaaagggcgtgaaaaggtttatccgtt cgtccatttgtatgtgcatgccaaccacagggttcccctcgggatcaaag tactttgatccaaccctccgctgctatagtgcagtcggcttctgacgtt cagtgcagccgtcttctgaaaacgacatgtcgcacaagtcctaagttacg cgacaggctgccgccctgccctttcctggcgttttcttgtcgcgtgttt tagtcgcataaagtagaatacttgcgactagaaccggagacattacgcca tgaacaagagcgccgccgctggcctgctggctatgcccgcgtcagcacc gacgaccaggacttgaccaaccaacgggccgaactgcacgcggccggctg caccaagctgttttccgagaagatcaccggcaccaggcgcgaccgcccgg agctggccaggatgcttgaccacctacgccctggcgacgttgtgacagtg accaggctagaccgcctggcccgcagcacccgcgacctactggacattgc cgagcgcatccaggaggccggcgcgggcctgcgtagcctggcagagccgt gggccgacaccaccgccggccggccgcatggtgttgaccgtgttcgcc ggcattgccgagttcgagcgttccctaatcatcgaccgcacccggagcgg gcgcgaggccgccaaggcccgaggcgtgaagtttggcccccgccctaccc tcaccccggcacagatcgcgcacgcccgcgagctgatcgaccaggaaggc cgcaccgtgaaagaggcggctgcactgcttggcgtgcatcgctcgaccct gtaccgcgcacttgagcgcagcgaggaagtgacgcccaccgaggccaggc ggcgcggtgccttccgtgaggacgcattgaccgaggccgacgccctggcg gccgccgagaatgaacgccaagaggaacaagcatgaaaccgcaccaggac ggccaggacgaaccgttttcattaccgaagagatcgaggcggagatgat cgcggccgggtacgtgttcgagccgccgcgcacgtctcaaccgtgcggc tgcatgaaatcctggccggtttgtctgatgccaagctggcggcctggccg gccagcttggccgctgaagaaaccgagcgccgccgtctaaaaaggtgatg tgtatttgagtaaaacagcttgcgtcatgcggtcgctgcgtatatgatgc gatgagtaaataaacaaatacgcaaggggaacgcatgaaggttatcgctg tacttaaccagaaaggcgggtcaggcaagacgaccatcgcaacccatcta gcccgcgccctgcaactcgccggggccgatgttctgttagtcgattccga tccccagggcagtgcccgcgattgggcggccgtgcgggaagatcaaccgc taaccgttgtcggcatcgaccgcccgacgattgaccgcgacgtgaaggcc atcggccggcgcgacttcgtagtgatcgacggagcgccccaggcggcgga cttggctgtgtccgcgatcaaggcagccgacttcgtgctgattccggtgc agccaagcccttacgacatatgggccaccgccgacctggtggagctggtt aagcagcgcattgaggtcacggatggaaggctacaagcggcctttgtcgt gtcgcgggcgatcaaaggcacgcgcatcggcggtgaggttgccgaggcgc tggccgggtacgagctgccattcttgagtcccgtatcacgcagcgcgtg agctacccaggcactgccgccgccggcacaaccgttcttgaatcagaacc cgagggcgacgctgcccgcgaggtccaggcgctggccgctgaaattaaat caaaactcatttgagttaatgaggtaaagagaaaatgagcaaaagcacaa acacgctaagtgccggccgtccgagcgcacgcagcagcaaggctgcaacg ttggccagcctggcagacacgccagccatgaagcgggtcaactttcagtt gccggcggaggatcacaccaagctgaagatgtacgcggtacgccaaggca agaccattaccgagctgctatctgaatacatcgcgcagctaccagagtaa atgagcaaatgaataaatgagtagatgaattttagcggctaaaggaggcg gcatggaaaatcaagaacaaccaggcaccgacgccgtggaatgccccatg tgtggaggaacgggcggttggccaggcgtaagcggctgggttgtctgccg gccctgcaatggcactggaaccccaagcccgaggaatcggcgtgagcgg tcgcaaaccatccggcccggtacaaatcggcgcggcgctgggtgatgacc tggtggagaagttgaaggccgcgcaggccgcccagcggcaacgcatcgag gcagaagcacgcccggtgaatcgtggcaagcggccgctgatcgaatccg caaagaatcccggcaaccgccggcagccggtgcgccgtcgattaggaagc cgcccaagggcgacgagcaaccagattttttcgttccgatgctctatgac gtgggcacccgcgatagtcgcagcatcatggacgtggccgttttccgtct gtcgaagcgtgaccgacgagctggcgaggtgatccgctacgagcttccag acgggcacgtagaggtttccgcagggccgccggcatggccagtgtgtgg gattacgacctggtactgatggcggtttcccatctaaccgaatccatgaa ccgataccgggaagggaagggagacaagcccggccgcgtgttccgtccac acgttgcggacgtactcaagttctgccggcgagccgatggcggaaagcag aaagacgacctggtagaaacctgcattcggttaaacaccacgcacgttgc catgcagcgtacgaagaaggccaagaacggccgcctggtgacggtatccg agggtgaagccttgattagccgctacaagatcgtaaagagcgaaaccggg cggcggagtacatcgagatcgagctagctgattggatgtaccgcgagat cacagaaggcaagaacccgacgtgctgacggttcaccccgattactttt tgatcgatcccggcatcggccgttttctctaccgcctggcgacgccgcc gcaggcaaggcagaagccagatggttgttcaagacgatctacgaacgcag tggcagcgccggagagttcaagaagttctgtttcaccgtgcgcaagctga tcgggtcaaatgacctgccggagtacgatttgaaggaggaggcggggcag gctggccgatcctagtcatgcgctaccgcaacctgatcgagggcgaagc atccgccggttcctaatgtacggagcagatgctagggcaaattgccctag |

TABLE 22-continued

Psilocybin expression vector sequences.

| SEQ ID NO. | Name | Sequence |
|---|---|---|
| | | cagggggaaaaaggtcgaaaaggtctctttcctgtggatagcacgtacatt<br>gggaacccaaagccgtacattgggaaccggaaccctacattgggaaccc<br>aaagccgtacattgggaaccggtcacacatgtaagtgactgatataaaag<br>agaaaaaaggcgattttccgcctaaaactcttaaaacttattaaaact<br>cttaaaacccgcctggcctgtgcataactgtctggccagcgcacagccga<br>agagctgcaaaaagcgcctacccttcggtcgctgcgctcctacgccccg<br>ccgcttcgcgtcggcctatcgcggccgctggccgctcaaaaatggctggc<br>ctacggccaggcaatctaccagggcgcggacaagccgcgccgtcgccact<br>cgaccgccggcgcccacatcaaggcaccctgcctcgcgcgtttcggtgat<br>gacggtgaaaacctctgacacatgcagctcccggagacggtcacagcttg<br>tctgtaagcggatgccgggagcagacaagcccgtcagggcgcgtcagcgg<br>gtgttggcgggtgtcggggcgcagccatgacccagtcacgtagcgatagc<br>ggagtgtatactggcttaactatgcggcatcagagcagattgtactgaga<br>gtgcaccatatgcggtgtgaaataccgcacagatgcgtaaggagaaaata<br>ccgcatcaggcgctcttccgcttcctcgctcactgactcgctgcgctcgg<br>tcgttcggctgcggcgagcggtatcagctcactcaaaggcggtaatacgg<br>ttatccacagaatcaggggataacgcaggaaagaacatgtgagcaaaagg<br>ccagcaaaaggccaggaaccgtaaaaaggccgcgttgctggcgtttttcc<br>ataggctccgcccccctgacgagcatcacaaaaatcgacgctcaagtcag<br>aggtggcgaaacccgacaggactataaagataccaggcgtttccccctgg<br>aagctccctcgtgcgctctcctgttccgaccctgccgcttaccggatacc<br>tgtccgcctttctcccttcgggaagcgtggcgctttctcatagctcacgc<br>tgtaggtatctcagttcggtgtaggtcgttcgctccaagctgggctgtgt<br>gcacgaaccccccgttcagcccgaccgctgcgccttatccggtaactatc<br>gtcttgagtccaacccggtaagacacgacttatcgccactggcagcagcc<br>actggtaacaggattagcagagcgaggtatgtaggcggtgctacagagtt<br>cttgaagtggtggcctaactacggctacactagaaggacagtatttggta<br>tctgcgctctgctgaagccagttaccttcggaaaaagagttggtagctct<br>tgatccggcaaacaaaccaccgctggtagcggtggtttttttgtttgcaa<br>gcagcagattacgcgcagaaaaaaaggatctcaagaagatcctttgatct<br>tttctacggggtctgacgctcagtggaacgaaaactcacgttaagggatt<br>ttggtcatgcattctaggtactaaaacaattcatccagtaaaatataata<br>ttttatttctcccaatcaggcttgatccccagtaagtcaaaaaatagct<br>cgacatactgttcttccccgatatcctccctgatcgaccggacgcagaag<br>gcaatgtcataccacttgtccgccctgccgcttctcccaagatcaataaa<br>gccacttactttgccatcttcacaaagatgttgctgtctcccaggtcgc<br>cgtgggaaaagacaagttcctcttcgggcttttccgtctttaaaaaatca<br>tacagctcgcgcggatctttaaatggagtgtcttcttcccagttttcgca<br>atccacatcggccagatcgttattcagtaagtaatccaattcggctaagc<br>ggctgtctaagctattcgtatagggacaatccgatatgtcgatggagtga<br>aagagcctgatgcactccgcatacagctcgataatcttttcagggctttg<br>ttcatcttcatactcttccgagcaaaggacgccatcggcctcactcatga<br>gcagattgctccagccatcatgccgttcaaagtgcaggacctttggaaca<br>ggcagctttccttccagccatagcatcatgtccttttcccgttccacatc<br>ataggtggtccctttataccggctgtccgtcatttttaaatataggtttt<br>cattttctcccaccagcttatataccttagcaggagacattccttccgta<br>tcttttacgcagcggtattttcgatcagtttttcaattccggtgatat<br>tctcattttagccatttattatttccttcctctttctacagtattaaa<br>gataccccaagaagctaattataacaagacgaactccaattcactgttcc<br>ttgcattctaaaaccttaaataccagaaaacagcttttcaaagttgttt<br>tcaaagttggcgtataacatagtatcgacggagccgattttgaaaccgcg<br>gtgatcacaggcagcaacgctctgtcatcgttacaatcaacatgctaccc<br>tccgcgagatcatccgtgtttcaaacccggcagcttagttgccgttcttc<br>cgaatagcatcggtaacatgagcaaagtctgccgccttacaacggctctc<br>ccgctgacgccgtcccggactgatgggctgcctgtatcgagtggtgattt<br>tgtgccgagctgccggtcggggagctgttggctggctggtggcaggatat<br>attgtggtgtaaacaaattgacgcttagacaacttaataacacattgcgg<br>acgttttaatgtactgaattaacgccgaattaattcgggggatctggat<br>tttagtactggattttggttttaggaattagaaatttattgatagaagt<br>attttacaaatacaaatacatactaagggtttcttatatgctcaacacat<br>gagcgaaacctataggaaccctaattcccttatctgggaactactcaca<br>cattattatggagaaactcgagcttgtcgatcgacagatccggtcggcat<br>ctactctatttctttgccctcggacgagtgctggggcgtcggtttccact<br>atcggcgagtacttctacacagccatcggtccagacggccgcgcttctgc<br>gggcgatttgtgtacgcccgacagtcccggctccggatcggacgattgcg<br>tcgcatcgaccctgcgcccaagctgcatcatcgaaattgccgtcaaccaa<br>gctctgatagagttggtcaagaccaatgcggagcatatacgcccggagtc<br>gtggcgatcctgcaagctccggatgcctccgctcgaagtagcgcgtctgc<br>tgctccatacaagccaaccacggcctccagaagaagatgttggcgacctc<br>gtattgggaatccccgaacatcgcctcgctccagtcaatgaccgctgtta<br>tgcggccattgtccgtcaggacattgttggagccgaaatccgcgtgcacg<br>aggtgccggacttcggggcagtcctcggcccaaagcatcagctcatcgag<br>agcctgcgcgacggacgcactgacggtgtcgtccatcacagtttgccagt<br>gatacacatggggatcagcaatcgcgcatatgaaatcacgccatgtagtg</br> |

TABLE 22-continued

Psilocybin expression vector sequences.

| SEQ ID NO. | Name | Sequence |
|---|---|---|
| | | tattgaccgattccttgcggtccgaatgggccgaacccgctcgtctggct
aagatcggccgcagcgatcgcatccatagcctccgcgaccggttgtagaa
cagcgggcagttcggtttcaggcaggtcttgcaacgtgacaccctgtgca
cggcgggagatgcaataggtcaggctctcgctaaactccccaatgtcaag
cacttccggaatcgggagcgcggccgatgcaaagtgccgataaacataac
gatctttgtagaaaccatcggcgcagctatttacccgcaggacatatcca
cgccctcctacatcgaagctgaaagcacgagattcttcgccctccgagag
ctgcatcaggtcggagacgctgtcgaacttttcgatcagaaacttctcga
cagacgtcgcggtgagttcaggcttttcatatctcattgcccccgggga
tctgcgaaagctcgagagatagatttgtagagagactggtgatttc
agcgtgtcctctccaaatgaaatgaacttccttatatagaggaaggtctt
gcgaaggatagtgggattgtgcgtcatcccttacgtcagtggagatatca
catcaatccacttgctttgaagacgtggttggaacgtcttcttttttccac
gatgctcctcgtggggggggtccatctttgggaccactgtcggcagaggc
atcttgaacgatagccttttcctttatcgcaatgatggcatttgtaggtgc
caccttcctttctactgtccttttgatgaagtgacagatagctgggcaa
tggaatccgaggaggtttcccgatattacccttgttgaaaagtctcaat
agccctttggtcttctgagactgtatctttgatattcttggagtagacga
gagtgtcgtgctccaccatgttatcacatcaatccacttgctttgaagac
gtggttggaacgtcttcttttttccacgatgctcctcgtggggggggtcca
tctttgggaccactgtcggcagaggcatcttgaacgatagcctttcctt
atcgcaatgatggcatttgtaggtgccaccttcctttctactgtcctttt
tgatgaagtgacagatagctgggcaatggaatccgaggaggtttcccgat
attaccctttgttgaaaagtctcaatagccctttggtcttctgagactgt
atctttgatattcttggagtagacgagagtgtcgtgctccaccatgttgg
caagctgctctagccaatacgcaaaccgcctctccccgcgcgttggccga
ttcattaatgcagctggcacgacaggtttcccgactggaaagcgggcagt
gagcgcaacgcaattaatgtgagttagctcactcattaggcaccccaggc
tttacactttatgcttccggctcgtatgttgtgtggaattgtgagcggat
aacaatttcacacaggaaacagctatgaccatgattacg |
| 108 | >pCambia1300_
GPDpromo_
start_
intron_
6bp_fuse_psi
Rstop_
35Sterm | aattcgagctcggtacccggggatcctctagagaggtccgcaagtagat
tgaaagttcagtacgtttttaacaatagagcattttcgaggcttgcgtca
ttctgtgtcaggctagcagtttataagcgttgaggatctagagctgctgt
tcccgcgtctcgaatgttctcggtgtttaggggttagcaatctgatatga
taataatttgtgatgacatcgatagtacaaaaacccaattccggctcaca
tccaccatctccgttttctcccatctacacacaacaagctcatcgccatg
gtttgtctctcgcttgcataccacccagcagctcactgatgtcgacttgt
aggttaaagcacccgcaacacccgcaactcacgatcctgccttgtcccac
ggagccctcctgctccaggtgctccagctcctgcaaatgctcctccaaa
cgcctcaggagacattgctggaatgcagctcagcggactcgatcagtccc
agatcatgaaccttcttcgttcattgcctggcatgttctcgggcggtaaa
ataccccgaccaaggccaaggcaacaaagaggatgctgctcaaacgctgtc
caaccttgcccaagctcaaccgtatggacaacaattacccctt cactacc
aagctggcggcccaggaggtctgccaggaattaacgacccaggcccgtcc
acacatccccgcggccctcccaaccttggccaactgagtgctgtggcaat
gcaagccgcccccgctccaattcagcatccagaccagcaaacgaaccgca
acgatggcgagcaggctggcaatgcgagtgcaagtacctccggaaaggat
ggtgacaatgcagaattcgttcccccacctgctcctgctcctacaactgg
tcgccgtggtggacgcagcgccaccatgggaagtgacgaatggagcagac
agaggaaggataatcataaagaggttgagcgtcgacgccgcggcaatatc
aacgagggcatcaacgagcttggccgcattgtacccagtgggtctggcga
gaaggccaaaggcgccatccttttctcgagctgtgcagtacatccatcatt
tgaaagagaacgaagctcgcaatatcgagaagtggacccttgagaagctt
ctcatggaccaggccatgggtgacctgcaggcgcaactcgaagaggtcaa
gcgtctgtgggaagaagagcgtatggcgcgcacaagactcgaggccgagc
tcgaagtgttgagaaatatgaacggcgtgaatgctggctcggccccggcc
tcgaaagatgagagtgctgcaggtactaagaggaggagtaccgatggagc
agaggccgccaccgccgccactgaaagcagcaccgccaatgccgagggcg
aacgcgacggcaagcgacaaagaaccgagtgaagtagatgccgaccggat
ctgtcgatcgacaagctcgagtttctccataataatgtgtgagtagttcc
cagataaggggaattagggttcctatagggtttcgctcatgtgttgagcat
ataagaaacccttagtatgtatttgtatttgtaaaatacttctatcaata
aaatttctaattcctaaaaccaaaatccagtactaaaatccagatcaagc
ttggcactggccgtcgttttacaacgtcgtgactgggaaaaccctggcgt
tacccaacttaatcgccttgcagcacatccccctttcgccagctggcgta
atagcgaagaggcccgcaccgatcgcccttcccaacagttgcgcagcctg
aatggcgaatgctagagcagcttgagcttggatcagattgtcgtttcccg
ccttcagtttaaactatcagtgtttgacaggatatattggcgggtaaacc
taagagaaaagagcgtttattagaataacggatatttaaaagggcgtgaa
aaggtttatccgttcgtccatttgtatgtgcatgccaaccacagggttcc
cctcgggatcaaagtactttgatccaacccctccgctgctatagtgcagt
cggcttctgacgttcagtgcagccgtcttctgaaaacgacatgtcgcaca
agtcctaagttacgcgacaggctgccgccctgcccttttcctggcgtttt |

TABLE 22-continued

Psilocybin expression vector sequences.

| SEQ ID NO. | Name | Sequence |
|---|---|---|
| | | cttgtcgcgtgttttagtcgcataaagtagaatacttgcgactagaaccg
gagacattacgccatgaacaagagcgccgccgctggcctgctgggctatg
cccgcgtcagcaccgacgaccaggacttgaccaaccaacgggccgaactg
cacgcggccggctgcaccaagctgttttccgagaagatcaccggcaccag
gcgcgaccgcccggagctggccaggatgcttgaccacctacgccctggcg
acgttgtgacagtgaccaggctagaccgcctggcccgcagcacccgcgac
ctactggacattgccgagcgcatccaggaggccggcgcgggcctgcgtag
cctggcagagccgtgggccgacaccaccacgccggccggccgcatggtgt
tgaccgtgttcgccggcattgccgagttcgagcgttccctaatcatcgac
cgcacccggagcgggcgcgaggccgccaaggcccgaggcgtgaagtttgg
ccccgccctaccctcaccccggcacagatcgcgcacgcccgcgagctga
tcgaccaggaaggccgcaccgtgaaagaggcggctgcactgcttggcgtg
catcgctcgaccctgtaccgcgcacttgagcgcagcgaggaagtgacgcc
caccgaggccaggcggcgcggtgccttccgtgaggacgcattgaccgagg
ccgacgccctggcggccgccgagaatgaacgccaagaggaacaagcatga
aaccgcaccaggacggccaggacgaaccgttttcattaccgaagagatc
gaggcggagatgatcgcggccgggtacgtgttcgagccgcccgcgcacgt
ctcaaccgtgcggctgcatgaaatcctggccggtttgtctgatgccaagc
tggcggcctggccggccagcttggccgctgaagaaaccgagcgccgccgt
ctaaaaaggtgatgtgtatttgagtaaaacagcttgcgtcatgcggtcgc
tgcgtatatgatgcgatgagtaaataaacaaatacgcaaggggaacgcat
gaaggttatcgctgtacttaaccagaaaggcgggtcaggcaagacgacca
tcgcaacccatctagcccgcgccctgcaactcgccggggccgatgttctg
ttagtcgattccgatccccagggcagtgcccgcgattgggcggccgtgcg
ggaagatcaaccgctaaccgttgtcggcatcgaccgcccgacgattgacc
gcgacgtgaaggccatcggccggcgcgacttcgtagtgatcgacggagcg
ccccaggcggcggacttggctgtgtccgcgatcaaggcagccgacttcgt
gctgattccggtgcagccaagcccttacgacatatgggccaccgccgacc
tggtggagctggttaagcagcgcattgaggtcacggatggaaggctacaa
gcggcctttgtcgtgtcgcgggcgatcaaaggcacgcgcatcggcggtga
ggttgccgaggcgctggccgggtacgagctgcccattcttgagtcccgta
tcacgcagcgcgtgagctacccaggcactgccgccgccggcacaaccgtt
cttgaatcagaacccgagggcgacgctgcccgcgaggtccaggcgctggc
cgctgaaattaaatcaaaactcatttgagttaatgaggtaaagagaaaat
gagcaaaagcacaaacacgctaagtgccggccgtccgagcgcacgcagca
gcaaggctgcaacgttggccagcctggcagacacgccagccatgaagcgg
gtcaactttcagttgccggcggaggatcacaccaagctgaagatgtacgc
ggtacgccaaggcaagaccattaccgagctgctatctgaatacatcgcgc
agctaccagagtaaatgagcaaatgaataaatgagtagatgaattttagc
ggctaaaggaggcggcatggaaaatcaagaacaaccaggcaccgacgccg
tggaatgcccccatgtgtggaggaacgggcggttggccaggcgtaagcggc
tgggttgtctgccggccctgcaatggcactggaacccccaagcccgagga
atcggcgtgagcggtcgcaaaccatccggcccggtacaaatcggcgcggc
gctgggtgatgacctggtggagaagttgaaggccgcgcgcaggccgcccagc
ggcaacgcatcgaggcagaagcacgcccccggtgaatcgtggcaagcggcc
gctgatcgaatccgcaaagaatcccggcaaccgccggcagccggtgcgcc
gtcgattaggaagccgcccaagggcgacgagcaaccagatttttcgttc
cgatgctctatgacgtgggcacccgcgatagtcgcagcatcatggacgtg
gccgttttccgtctgtcgaagcgtgaccgacgagctggcgaggtgatccg
ctacgagcttccagacgggcacgtagaggtttccgcagggccggccggca
tggccagtgtgtgggattacgacctggtactgatggcggtttccatccta
accgaatccatgaaccgataccgggaagggaagggagacaagcccggccg
cgtgttccgtccacacgttgcggacgtactcaagttctgccggcgagccg
atggcggaaagcagaaagacgacctggtagaaacctgcattcggttaaac
accacgcacgttgccatgcagcgtacgaagaaggccaagaacggccgcct
ggtgacggtatccgagggtgaagccttgattagccgctacaagatcgtaa
agagcgaaaccgggcggccggagtacatcgagatcgagctagctgattgg
atgtaccgcgagatcacagaaggcaagaacccggacgtgctgacggttca
ccccgattacttttgatcgatcccggcatcggccgttttctctaccgcc
tggcacgccgcgccgcaggcaaggcagaagccagatggttgttcaagacg
atctacgaacgcagtggcagcgccggagagttcaagaagttctgtttcac
cgtgcgcaagctgatcgggtcaaatgacctgccggagtacgatttgaagg
aggaggcggggcaggctggcccgatcctagtcatgcgctaccgcaacctg
atcgagggcgaagcatccgccggttcctaatgtacggagcagatgctagg
gcaaattgccctagcaggggaaaaaggtcgaaaaggtctcttttcctgtgg
atagcacgtacattgggaacccaaagccgtacattgggaaccggaacccg
tacattgggaacccaaagccgtacattgggaaccggtcacacatgtaagt
gactgatataaaagagaaaaaggcgattttccgcctaaaactcttta
aactttattaaaactcttaaaacccgcctggcctgtgcataactgtctggc
cagcgcacagccgaagagctgcaaaaagcgcctacccttcggtcgctgcg
ctccctacgccccgccgcttcgcgtcggcctatcgcggccgctggccgct
caaaaatggctggcctacgccaggcaatctaccagggcgcggacaagcc
gcgccgtcgccactcgaccgccggcgcccacatcaaggcaccctgcctcg
cgcgtttcggtgatgacggtgaaaacctctgacacatgcagctcccggag |

TABLE 22-continued

Psilocybin expression vector sequences.

| SEQ ID NO. | Name | Sequence |
|---|---|---|
| | | acggtcacagcttgtctgtaagcggatgccgggagcagacaagcccgtca gggcgcgtcagcgggtgttggcgggtgtcggggcgcagccatgacccagt cacgtagcgatagcggagtgtatactggcttaactatgcggcatcagagc agattgtactgagagtgcaccatatgcggtgtgaaataccgcacagatgc gtaaggagaaaataccgcatcaggcgctcttccgcttcctcgctcactga ctcgctgcgctcggtcgttcggctgcggcgagcggtatcagctcactcaa aggcggtaatacggttatccacagaatcaggggataacgcaggaaagaac atgtgagcaaaaggccagcaaaaggccaggaaccgtaaaaaggccgcgtt gctggcgttttccataggctccgcccccctgacgagcatcacaaaaatc gacgctcaagtcagaggtggcgaaacccgacaggactataaagataccag gcgtttccccctggaagctccctcgtgcgctctcctgttccgaccctgcc gcttaccggatacctgtccgcctttctcccttcgggaagcgtggcgcttt ctcatagctcacgctgtaggtatctcagttcggtgtaggtcgttcgctcc aagctgggctgtgtgcacgaaccccccgttcagcccgaccgctgcgcctt atccggtaactatcgtcttgagtccaacccggtaagacacgacttatcgc cactggcagcagccactggtaacaggattagcagagcgaggtatgtaggc ggtgctacagagttcttgaagtggtggcctaactacggctacactagaag gacagtatttggtatctgcgctctgctgaagccagttaccttcggaaaaa gagttggtagctcttgatccggcaaacaaaccaccgctggtagcggtggt ttttttgtttgcaagcagcagattacgcgcagaaaaaaaggatctcaaga agatcctttgatcttttctacggggtctgacgctcagtggaacgaaaact cacgttaagggattttggtcatgcattctaggtactaaaacaattcatcc agtaaaatataatattttattttctcccaatcaggcttgatccccagtaa gtcaaaaaatagctcgacatactgttcttccccgatatcctccctgatcg accggacgcagaaggcaatgtcataccacttgtccgccctgccgcttctc ccaagatcaataaagccacttactttgccatctttcacaaagatgttgct gtctcccaggtcgccgtgggaaaagacaagttcctcttcgggcttttccg tctttaaaaaatcatacagctcgcgcggatctttaaatggagtgtcttct tcccagttttcgcaatccacatcggccagatcgttattcagtaagtaatc caattcggctaagcggctgtctaagctattcgtatagggacaatccgata tgtcgatggagtgaaagagcctgatgcactccgcatacagctcgataatc ttttcagggctttgttcatcttcatactcttccgagcaaaggacgccatc ggcctcactcatgagcagattgctccagccatcatgccgttcaaagtgca ggacctttggaacaggcagctttccttccagccatagcatcatgtcctt tcccgttccacatcataggtggtccctttataccggctgtccgtcatttt taaatataggttttcattttctcccaccagctctatatacccttagcaggag acattccttccgtatcttttacgcagcggtatttttcgatcagtttttc aattccggtgatattctcattttagccatttattatttccttcctctttt ctacagtatttaaagataccccaagaagctaattataacaagacgaactc caattcactgttccttgcattctaaaaccttaaataccagaaaacagctt tttcaaagttgttttcaaagttggcgtataacatagtatcgacggagccg attttgaaaccgcggtgatcacaggcagcaacgctctgtcatcgttacaa tcaacatgctaccctccgcgagatcatccgtgtttcaaacccggcagctt agttgccgttcttccgaatagcatcggtaacatgagcaaagtctgccgcc ttacaacggctctcccgctgacgccgtcccggactgatgggctgcctgta tcgagtggtgattttgtgccgagctgccggtcggggagctgttggctggc tggtggcaggatatattgtggtgtaaacaaattgacgcttagacaactta ataacacattgcggacgtttttaatgtactgaattaacgccgaattaatt cgggggatctggatttttagtactggattttggttttaggaattagaaatt ttattgatagaagtattttacaaatacaaatacatactaagggtttctta tatgctcaacacatgagcgaaaccctataggaaccctaattcccttatct gggaactactcacacattattatgggagaaactcgagcttgtcgatcgaca gatccggtcggcatctactctatttctttgccctcggacgagtgctgggg cgtcggtttccactatcggcgagtacttctacacagccatcggtccagac ggccgcgcttctgcgggcgatttgtgtacgcccgacagtcccggctccgg atcggacgattgcgtcgcatcgaccctgcgcccaagctgcatcatcgaaa ttgccgtcaaccaagctctgatagagttggtcaagaccaatgcggagcat atacgcccggagtcgtggcgatcctgcaagctccggatgcctccgctcga agtagcgcgtctgctgctccatacaagccaaccacggcctccagaagaag atgttggcgacctcgtattgggaatccccgaacatcgcctcgctccagtc aatgaccgctgttatgcggccattgtccgtcaggacattgttggagccga aatccgcgtgcacgaggtgccggacttcggggcagtcctcggcccaaagc atcagctcatcgagagcctgcgcgacggacgcactgacggtgtcgtccat cacagtttgccagtgatacacatggggatcagcaatcgcgcatatgaaat cacgccatgtagtgtattgaccgattccttgcggtccgaatgggccgaac ccgctcgtctggctaagatcggccgcagcgatcgcatccatagcctccgc gaccggttgtagaacagcgggcagttcggtttcaggcaggtcttgcaacg tgacaccctgtgcacgcgggagatgcaataggtcaggctctcgctaaac tcccaatgtcaagcacttccggaatcgggagcgcggccgatgcaaagtg ccgataaacataacgatctttgtagaaaccatcggcgcagctatttaccc gcaggacatatccacgccctcctacatcgaagctgaaagcacgagattct tcgccctccgagagctgcatcaggtcggagacgctgtcgaacttttcgat cagaaacttctcgacagacgtcgcggtgagttcaggcttttttcatatctc attgccccccgggatctgcgaaagctcgagagagatagatttgtagagag |

TABLE 22-continued

Psilocybin expression vector sequences.

| SEQ ID NO. | Name | Sequence |
|---|---|---|
| | | agactggtgatttcagcgtgtcctctccaaatgaaatgaacttccttata<br>tagaggaaggtcttgcgaaggatagtgggattgtgcgtcatcccttacgt<br>cagtggagatatcacatcaatccacttgctttgaagacgtggttggaacg<br>tcttcttttccacgatgctcctcgtgggggggtccatctttgggacca<br>ctgtcggcagaggcatcttgaacgatagcctttccttatcgcaatgatg<br>gcatttgtaggtgccaccttccttttctactgtccttttgatgaagtgac<br>agatagctgggcaatggaatccgaggaggtttcccgatattacccttgt<br>tgaaaagtctcaatagcccttggtcttctgagactgtatctttgatatt<br>cttggagtagacgagagtgtcgtgctccaccatgttatcacatcaatcca<br>cttgctttgaagacgtggttggaacgtcttcttttccacgatgctcctc<br>gtgggggggtccatctttgggaccactgtcggcagaggcatcttgaacg<br>atagcctttccttatcgcaatgatggcatttgtaggtgccaccttcctt<br>ttctactgtccttttgatgaagtgacagatagctgggcaatggaatccga<br>ggaggtttcccgatattacccttgttgaaaagtctcaatagcccttggt<br>tcttctgagactgtatctttgatattcttggagtagacgagagtgtcgtg<br>ctccaccatgttggcaagctgctctagccaatacgcaaaccgcctctccc<br>cgcgcgttggccgattcattaatgcagctggcacgacaggtttcccgact<br>ggaaagcgggcagtgagcgcaacgcaattaatgtgagttagctcactcat<br>taggcaccccaggctttacactttatgcttccggctcgtatgttgtgtgg<br>aattgtgagcggataacaatttcacacaggaaacagctatgaccatgatt<br>acg |
| 109 | >pCambia1300_<br>GPDpromo_<br>start_intron<br>6bp_fuse_psi<br>H2cds<br>tampanensis_<br>stop_35Sterm | aattcgagctcggtacccggggatcctctagagaggtccgcaagtagatt<br>gaaagttcagtacgttttaacaatagagcattttcgaggcttgcgtcat<br>tctgtgtcaggctagcagtttataagcgttgaggatctagagctgctgtt<br>cccgcgtctcgaatgttctcggtgtttaggggttagcaatctgatatgat<br>aataatttgtgatgacatcgatagtacaaaaacccccaattccggtcacat<br>ccaccatctccgttttctcccatctacacacaacaagctcatcgccatgg<br>tttgtctctcgcttgcataccacccagcagctcactgatgtcgacttgta<br>ggttaaacaaaacggcgcactcactgtatttgttgcatttatttctgcag<br>cgtgcatatactatgtgcacgctcgtcgggctcggcgagcctcgctgcca<br>ccaggtccgcgcggaatacccctgccatttgtggggaatgtattcgatat<br>gccttcggagtcttcttggctcacgttcctggaatggggaaaacagtatc<br>aatctgatttgatctacttaaactccggggggaatagaaatggtcattctg<br>aacacgttgaaacaatgaccgatctcttggagaagagggatctatata<br>ttcaggacgactagaaagtacaatggtcaatgaactcatgggttggaaat<br>tcgattttggattcgtgacctatggcgagcgctggcgagaagaaagacgc<br>atgttttcgagggagttcaacgagaaaaatatcaaacaatttcgtcatgc<br>acaagtcaaggccctcaaagaactcgttcggaaacttgacaaagacccaa<br>gtcgatggtaccagcatcttcgacaccaaattgcatctatggcctggat<br>attggctatggaattgatctcgcagaaaacgacccatggattgaagagac<br>catcctcgcaaacgatgctctagcccttgcatctgtccctgggtgctatt<br>gggttgactcgtttcccattcttcaatatgttccatcttggcttcccttt<br>gcaggattcaagcgcaaagcaaaggtgtgaagaaaaataccgagtacat<br>ggtcaacgttctatacgagaccatgaaaagacagacagtacaagggttaa<br>cccgtccatcctatgcttcagcacgtttacaggccatggctccagacatt<br>aaccttgaacatcaagaacgggtaattaaaaattcagcctcacaggttat<br>tgttggcggtggcgatactaccgtgtctgcattggcagcatttattctag<br>ctatggtcaaatatcctaatgtccaacgcaaggtccaggcggagctcgac<br>gcgatcgcgagccaaaacgaaataccgactttgacgaagaaatggaac<br>gatgccatacctcaccgcatgtctcaaagaagttttccgctggaaccaga<br>tcgcgccccttggtatcgcccaccggcttgacaaggacgattcttaccgt<br>ggctacctcatacccaagggaaccttggttttgccaacatttgggctat<br>cttgaacgatccattgatgtatcctaatcctggcgagtttcaacctgagc<br>gatatctcggacctgacggcaagcacgatccctctgtgcgcgacccacgt<br>aaaattgccttcggctggggtcgacgcgcttgtcccggcatatacttggc<br>acaatccaccgtatggcacacagcaacgaacctcctctctgcattcaaca<br>tagagccacctcttaacgaagagggaaagcctatcaaagtcgaggcggct<br>ttcaccactggattttcaggtatagtccccgcagtgatgcatgaagtag<br>atgccgaccggatctgtcgatcgacaagctcgagtttctccataataatg<br>tgtgagtagttcccagataagggaattagggttcctatagggtttcgctc<br>atgtgttgagcatataagaaaccctagtatgtatttgtatttgtaaaat<br>acttctatcaataaaatttctaattcctaaaaccaaaatccagtactaaa<br>atccagatcaagcttggcactggccgtcgttttacaacgtcgtgactggg<br>aaaaccctggcgttacccaacttaatcgccttgcagcacatccccctttc<br>gccagctggcgtaatagcgaagaggcccgcaccgatcgcccttcccaaca<br>gttgcgcagcctgaatggcgaatgctagagcagcttgagcttggatcaga<br>ttgtcgtttcccgccttcagtttaaactatcagtgtttgacaggatatat<br>tgggggtaaacctaagagaaaagagcgtttattagaataacggatattta<br>aaagggcgtgaaaaggtttatccgttcgtccatttgtatgtgcatgccaa<br>ccacagggttccctcgggatcaaagtactttgatccaacccctccgctg<br>ctatagtgcagtcggcttctgacgttcagtgcagccgtcttctgaaaacg<br>acatgtcgcacaagtcctaagttacgcgacaggctgccgccctgcccttt<br>tcctggcgttttcttgtcgcgtgttttagtcgcataaagtagaatacttg |

TABLE 22-continued

Psilocybin expression vector sequences.

| SEQ ID NO. | Name | Sequence |
|---|---|---|
| | | cgactagaaccggagacattacgccatgaacaagagcgccgccgctggcc
tgctgggctatgcccgcgtcagcaccgacgaccaggacttgaccaaccaa
cgggccgaactgcacgcggccggctgcaccaagctgttttccgagaagat
caccggcaccaggcgcgaccgcccggagctggccaggatgcttgaccacc
tacgccctggcgacgttgtgacagtgaccaggctagaccgcctggcccgc
agcacccgcgacctactggacattgccgagcgcatccaggaggccggcgc
gggcctgcgtagcctggcagagccgtgggccgacaccaccacgccggccg
gccgcatggtgttgaccgtgttcgccggcattgccgagttcgagcgttcc
ctaatcatcgaccgcaccggagcgggcgcgaggccgccaaggcccgagg
cgtgaagtttggccccgccctaccctcacccggcacagatcgcgcacg
cccgcgagctgatcgaccaggaaggccgcaccgtgaaagaggcggctgca
ctgcttggcgtgcatcgctcgaccctgtaccgcgcacttgagcgcagcga
ggaagtgacgcccaccgaggccaggcggcgcggtgccttccgtgaggacg
cattgaccgaggccgacgccctggcggccgccgagaatgaacgccaagag
gaacaagcatgaaaccgcaccaggacggccaggacgaaccgttttttcatt
accgaagagatcgaggcggagatgatcgcggccgggtacgtgttcgagcc
gcccgcgcacgtctcaaccgtgcggctgcatgaaatcctggccggtttgt
ctgatgccaagctggcggcctggccggccagcttggccgctgaagaaacc
gagcgccgccgtctaaaaaggtgatgtgtatttgagtaaaacagcttgcg
tcatgcggtcgctgcgtatatgatgcgatgagtaaataaacaaatacgca
aggggaacgcatgaaggttatcgctgtacttaaccagaaaggggggtcagg
caagacgaccatcgcaacccatctagcccgcgccctgcaactcgccgggg
ccgatgttctgttagtcgattccgatccccagggcagtgcccgcgattgg
gcggccgtgcgggaagatcaacgctaaccgttgtcggcatcgaccgccc
gacgattgaccgcgacgtgaaggccatcggccggcgcgacttcgtagtga
tcgacggagcgccccaggcggcggacttggctgtgtccgcgatcaaggca
gccgacttcgtgctgattccggtgcagccaagcccttacgacatatgggc
caccgccgacctggtgggagctggttaagcagcgcattgaggtcacggatg
gaaggctacaagcggcctttgtcgtgtcgcgggcgatcaaaggcacgcgc
atcggcggtgaggttgccgaggcgctggccgggtacgagctgcccattct
tgagtcccgtatcacgcagcgcgtgagctacccaggcactgccgccgccg
gcacaaccgttcttgaatcagaacccgagggcgacgctgcccgcgaggtc
caggcgctggccgctgaaattaaatcaaaactcatttgagttaatgaggt
aaagagaaaatgagcaaaagcacaaacacgctaagtgccggccgtccgag
cgcacgcagcagcaaggctgcaacgttggccagcctggcagacacgccag
ccatgaagcgggtcaactttcagttgccggcggaggatcacaccaagctg
aagatgtacgcggtacgccaaggcaagaccattaccgagctgctatctga
atacatcgcgcagctaccagagtaaatgagcaaatgaataaatgagtaga
tgaattttagcggctaaaggaggcggcatggaaaatcaagaacaaccagg
caccgacgccgtggaatgccccatgtgtggaggaacgggcggttggccag
gcgtaagcggctgggttgtctgccggccctgcaatggcactggaaccccc
aagcccgaggaatcggcgtgagcggtcgcaaaccatccggcccggtacaa
atcggcgcggcgctgggtgatgacctggtggagaagttgaaggccgcgca
ggccgcccagcggcaacgcatcgaggcagaagcacgcccccggtgaatcgt
ggcaagcggccgctgatcgaatccgcaaagaatcccggcaaccgccggca
gccggtgcgccgtcgattaggaagccgcccaagggcgacgagcaaccaga
ttttttcgttccgatgctctatgacgtgggcacccgcgatagtcgcagca
tcatggacgtggccgttttccgtctgtcgaagcgtgaccgacgagctggc
gaggtgatccgctacgagcttccagacgggcacgtagaggtttccgcagg
gccggccggcatggccagtgtgtgggattacgacctggtactgatggcgg
tttcccatctaaccgaatccatgaaccgataccgggaagggaagggagac
aagcccggccgcgtgttccgtccacacgttgcggacgtactcaagttctg
ccggcgagccgatggcggaaagcagaaagacgacctggtagaaacctgca
ttcggttaaacaccacgcacgttgccatgcagcgtacgaagaaggccaag
aacgccgcctggtgacggtatccgagggtgaagccttgattagccgcta
caagatcgtaaagagcgaaaccgggcggccggagtacatcgagatcgagc
tagctgattggatgtaccgcgagatcacagaaggcaagaacccggacgtg
ctgacggttcaccccgattacttttttgatcgatcccggcatcggccgttt
tctctaccgcctggcacgccgccgcaggcaaggcagaagccagatggt
tgttcaagacgatctacgaacgcagtggcagcgccggagagttcaagaag
ttctgtttccaccgtgcgcaactgatcgggtcaaatgacctgccggagta
cgatttgaaggaggaggcggggcaggctggcccgatcctagtcatgcgct
accgcaacctgatcgagggcgaagcatccgccggttcctaatgtacggag
cagatgctagggcaaattgccctagcaggggaaaaaggtcgaaaaggtct
ctttcctgtggatagcacgtacattgggaacccaaagccgtacattggga
accggaacccgtacattgggaacccaaagccgtacattgggaaccggtca
cacatgtaagtgactgatataaaagagaaaaaaggcgatttttccgccta
aaactctttaaaacttattaaaactcttaaaacccgcctggcctgtgcat
aactgtctggccagcgcacagccgaagagctgcaaaaagcgcctaccctt
cggtcgctgcgctccctacgccccgccgcttcgcgtcggcctatcgcggc
cgctggccgctcaaaaatggctggcctacggccaggcaatctaccagggc
gcggacaagccgcgccgtcgccactcgaccgccggcgcccacatcaaggc
accctgcctcgcgcgtttcggtgatgacggtgaaaacctctgacacatgc
agctcccggagacggtcacagcttgtctgtaagcggatgccgggagcaga |

TABLE 22-continued

Psilocybin expression vector sequences.

| SEQ ID NO. | Name | Sequence |
|---|---|---|
| | | caagcccgtcagggcgcgtcagcgggtgttggcgggtgtcggggcgcagc
catgacccagtcacgtagcgatagcggagtgtatactggcttaactatgc
ggcatcagagcagattgtactgagagtgcaccatatgcggtgtgaaatac
cgcacagatgcgtaaggagaaaataccgcatcaggcgctcttccgcttcc
tcgctcactgactcgctgcgctcggtcgttcggctgcggcgagcggtatc
agctcactcaaaggcggtaatacggttatccacagaatcaggggataacg
caggaaagaacatgtgagcaaaaggccagcaaaaggccaggaaccgtaaa
aaggccgcgttgctggcgtttttccataggctccgcccccctgacgagca
tcacaaaaatcgacgctcaagtcagaggtggcgaaacccgacaggactat
aaagataccaggcgtttccccctggaagctccctcgtgcgctctcctgtt
ccgaccctgccgcttaccggatacctgtccgcctttctcccttcgggaag
cgtggcgctttctcatagctcacgctgtaggtatctcagttcggtgtagg
tcgttcgctccaagctgggctgtgtgcacgaaccccccgttcagcccgac
cgctgcgccttatccggtaactatcgtcttgagtccaacccggtaagaca
cgacttatcgccactggcagcagccactggtaacaggattagcagagcga
ggtatgtaggcggtgctacagagttcttgaagtggtggcctaactacggc
tacactagaaggacagtatttggtatctgcgctctgctgaagccagttac
cttcggaaaaagagttggtagctcttgatccggcaaacaaaccaccgctg
gtagcggtggtttttttgtttgcaagcagcagattacgcgcagaaaaaaa
ggatctcaagaagatcctttgatcttttctacggggtctgacgctcagtg
gaacgaaaactcacgttaagggattttggtcatgcattctaggtactaaa
acaattcatccagtaaaatataatattttattttctcccaatcaggcttg
atccccagtaagtcaaaaaatagctcgacatactgttcttccccgatatc
ctccctgatcgaccggacgcagaaggcaatgtcataccacttgtccgccc
tgccgcttctcccaagatcaataaagccacttactttgccatctttcaca
aagatgttgctgtctcccaggtcgccgtgggaaaagacaagttcctcttc
gggcttttccgtctttaaaaaatcatacagctcgcgcggatctttaaatg
gagtgtcttcttcccagttttcgcaatccacatcggccagatcgttattc
agtaagtaatccaattcggctaagcggctgtctaagctattcgtataggg
acaatccgatatgtcgatggagtgaaagagcctgatgcactccgcataca
gctcgataatcttttcagggctttgttcatcttcatactcttccgagcaa
aggacgccatcggcctcactcatgagcagattgctccagccatcatgccg
ttcaaagtgcaggacctttggaacaggcagctttccttccagccatagca
tcatgtccttttcccgttccacatcataggtggtccctttataccggctg
tccgtcatttttaaatataggttttcattttctcccaccagcttatatac
cttagcaggagacattccttccgtatcttttacgcagcggtattttcga
tcagttttttcaattccggtgatattctcattttagccatttattatttc
cttcctcttttctacagtatttaaagataccccaagaagctaattataac
aagacgaactccaattcactgttccttgcattctaaaaccttaaatacca
gaaaacagcttttttcaaagttgttttcaaagttggcgtataacatagtat
cgacggagccgattttgaaaccgcggtgatcacaggcagcaacgctctgt
catcgttacaatcaacatgctaccctccgcgagatcatccgtgtttcaaa
cccggcagcttagttgccgttcttccgaatagcatcggtaacatgagcaa
agtctgccgccttacaacggctctcccgctgacgccgtcccggactgatg
ggctgcctgtatcgagtggtgattttgtgccgagctgccggtcggggagc
tgttggctggctggtggcaggatatattgtggtgtaaacaaattgacgct
tagacaacttaataacacattgcggacgtttttaatgtactgaattaacg
ccgaattaattcggggatctggattttagtactggattttggttttagg
aattagaaattttattgataagaagtattttacaaatacaaatacatacta
agggtttcttatatgctcaacacatgagcgaaaccctataggaaccctaa
ttcccttatctgggaactactcacacattattatggagaaactcgagctt
gtcgatcgacagatccggtcggcatctactctatttctttgccctcggac
gagtgctggggcgtcggtttccactatcggcgagtacttctacacagcca
tcggtccagacggccgcgcttctgcgggcgatttgtgtacgcccgacagt
cccggctccggatcggacgattgcgtcgcatcgaccctgcgcccaagctg
catcatcgaaattgccgtcaaccaagctctgatagagttggtcaagacca
atgcggagcatatacgcccggagtcgtggcgatcctgcaagctccggatg
cctccgctcgaagtagcgcgtctgctgctccatacaagccaaccacggcc
tccagaagaagatgttggcgacctcgtattgggaatccccgaacatcgcc
tcgctccagtcaatgaccgctgttatgcggccattgtccgtcaggacatt
gttggagccgaaatccgcgtgcacgaggtgccggacttcggggcagtcct
cggcccaaagcatcagctcatcgagagcctgcgcgacggacgcactgacg
gtgtcgtccatcacagtttgccagtgatacacatggggatcagcaatcgc
gcatatgaaatcacgccatgtagtgtattgaccgattccttgcggtccga
atgggccgaacccgctcgtctggctaagatcggccgcagcgatcgcatcc
atagcctccgcgaccggttgtagaacagcgggcagttcggtttcaggcag
gtcttgcaacgtgacaccctgtgcacggcgggagatgcaataggtcaggc
tctcgctaaactccccaatgtcaagcacttccggaatcgggagcgcggcc
gatgcaaagtgccgataaacataacgatctttgtagaaaccatcggcgca
gctatttacccgcaggacatatccacgccctcctacatcgaagctgaaag
cacgagattcttcgccctccgagagctgcatcaggtcggagacgctgtcg
aacttttcgatcagaaacttctcgacagacgtcgcggtgagttcaggctt
tttcatatctcattgcccccgggatctgcgaaagctcgagagagataga
tttgtagagagagactggtgatttcagcgtgtcctctccaaatgaaatga |

TABLE 22-continued

Psilocybin expression vector sequences.

| SEQ ID NO. | Name | Sequence |
|---|---|---|
| | | acttccttatatagaggaaggtcttgcgaaggatagtgggattgtgcgtc<br>atcccttacgtcagtggagatatcacatcaatccacttgctttgaagacg<br>tggttggaacgtcttcttttccacgatgctcctcgtgggggggtccat<br>ctttgggaccactgtcggcagaggcatcttgaacgatagccttcttta<br>tcgcaatgatggcatttgtaggtgccaccttcttttctactgtcctttt<br>gatgaagtgacagatagctgggcaatggaatccgaggaggtttcccgata<br>ttacccttgttgaaaagtctcaatagccctttggtcttctgagactgta<br>tctttgatattcttggagtagacgagagtgtcgtgctccaccatgttatc<br>acatcaatccacttgctttgaagacgtggttggaacgtcttcttttcca<br>cgatgctcctcgtgggtggggtccatctttgggaccactgtcggcagag<br>gcatcttgaacgatagccttcctttatcgcaatgatggcatttgtaggt<br>gccaccttcttttctactgtccttttgatgaagtgacagatagctgggc<br>aatggaatccgaggaggtttcccgatattacccttgttgaaaagtctca<br>atagcccttggtcttctgagactgtatctttgatattcttggagtagac<br>gagagtgtcgtgctccaccatgttggcaagctgctctagccaatacgcaa<br>accgcctctccccgcgcgttggccgattcattaatgcagctggcacgaca<br>ggtttcccgactggaaagcgggcagtgagcgcaacgcaattaatgtgagt<br>tagctcactcattaggcacccaggctttacactttatgcttccggctcg<br>tatgttgtgtggaattgtgagcggataacaatttcacacaggaaacagct<br>atgaccatgattacg |
| 110 | >pCambia1300_<br>GPDpromo_<br>start_intron<br>6bp_fuse_psi<br>H2cds<br>cyanescens_<br>stop_35Sterm | aattcgagctcggtacccgggatcctctagagaggtccgcaagtagatt<br>gaaagttcagtacgttttaacaatagagcattttcgaggcttgcgtcat<br>tctgtgtcaggctagcagtttataagcgttgaggatctagagctgctgtt<br>cccgcgtctcgaatgttctcggtgtttagggggttagcaatctgatatgat<br>aataatttgtgatgacatcgatagtacaaaaaccccaattccggtcacat<br>ccaccatctccgttttctcccatctacacacaacaagctcatcgccatgg<br>tttgtctctcgcttgcataccacccagcagctcactgatgtcgacttgta<br>ggttaaagcacctctcaccaccatgatccccatagtactctcgctcctca<br>tagcaggatgcatatactacatcaacgctcgcaggataaagcgttcccgc<br>ttaccccctggaccgcctggcataccatccccattcattgggaatatgtt<br>tgatatgccttcagagtctccatggttgatcttttacaatggggacagg<br>aatatcaaaccgacatcatctacgtcgatgctggaggaacggacatgatt<br>attctgaactcattggaggctataaccgacttgttggaaaagcgggggtc<br>cctgtactccggtcgactcgagagcacgatggtgaacgagctcatgggat<br>gggagttcgattttggattcataccctacggcgagagatgggcgcaagaa<br>aggcgcatgttcgccaaggagttcagcgagaaaaatataaggcaattccg<br>ccacgctcaagtgaaggctgccaatcagcttgtccggcagctgacagaca<br>agccagatcgttggtcacaccatccggcatcagatagcgtctatggct<br>ctggatattggctatgggatcgatctggccgaggatgatccctgattgc<br>agcatctgagctagcaaacgaagggctcgctgttgcatcagtgccgggca<br>gtttctgggtcgacacattcccttcctttaaataccttccgtcctggctt<br>ccaggtgctgaattcaagcgcaatgcaaagatgtggaaggaaggcgctga<br>ccatatggtgaatatgccatatgaaacaatgaaaaaactgtctgctcaag<br>gtttgacccgaccctcatacgcctcggctcgcctccaggctatggatcct<br>aatggcgatctcgagcaccaggaacgtgtgatcaagaatacggccacaca<br>agtcaatgtcggtggcggtgatacgactgtcggtgctgtgtcagcattta<br>ttttagctatggtcaaatatcccgaggttcaacgtaaagtccaagctgag<br>ctggatgaattcacgagtaaaggccgtatcccagattacgacgaagataa<br>cgactccttgccgtatctcagcgcatgctttaaggaactctttcgatggg<br>gccagattgcaccccttgctattgctcatcgacttatcaaggatgatgtt<br>taccgcgagtatactatacctaagaatgctttggtcttcgctaataattg<br>gtacggacggactgtactgaacgatccctctgagtatccaaatccctctg<br>agttccgtccagaacgatatctcggtcctgacgggaagcccgacgatacg<br>gttcgtgatccccgcaaagcagcattcgggtatggtcgtcgcgtttgccc<br>tggaatccaccttgctcagtcgacggtatggattgcaggggtggctcttg<br>tgtccgcgttcaacatcgaactgcctgttgataaggatgggaaatgtatt<br>gacataccagcggcgtttacaacaggattttttcaggtaaagtagatgccg<br>accggatctgtcgatcgacaagctcgagtttctccataataatgtgtgag<br>tagttcccagataagggaattagggttcctataggggtttcgctcatgtgt<br>tgagcatataagaaaccctttagtatgtatttttgtatttgtaaaatacttct<br>atcaataaaatttctaattcctaaaaccaaaatccagtactaaaatccag<br>atcaagcttggcactggccgtcgttttacaacgtcgtgactgggaaaacc<br>ctggcgttacccaacttaatcgccttgcagcacatccccctttcgccagc<br>tggcgtaatagcgaagaggcccgcaccgatcgcccttcccaacagttgcg<br>cagcctgaatggcgaatgctagagcagcttgagcttggatcagattgtcg<br>tttccgcctttcagtttaaactatcagtgtttgacaggatatattggcgg<br>gtaaacctaagagaaaagagcgtttattagaataacggatatttaaaagg<br>gcgtgaaaaggtttatccgttcgtccatttgtatgtgcatgccaaccaca<br>gggttccctcgggatcaaagtactttgatccaaccctccgctgctata<br>gtgcagtcggcttctgacgttcagtgcagccgtcttctgaaaacgacatg<br>tcgcacaagtcctaagttacgcgacaggctgccgccctgcccttttcctg<br>gcgttttcttgtcgcgtgttttagtcgcataaagtagaatacttgcgact<br>agaaccggagacattacgccatgaacaagagcgccgccgctggcctgctg |

TABLE 22-continued

Psilocybin expression vector sequences.

| SEQ ID NO. | Name | Sequence |
|---|---|---|
| | | ggctatgcccgcgtcagcaccgacgaccaggacttgaccaaccaacgggc |
| | | cgaactgcacgcggccggctgcaccaagctgttttccgagaagatcaccg |
| | | gcaccaggcgcgaccgcccggagctggccaggatgcttgaccacctacgc |
| | | cctggcgacgttgtgacagtgaccaggctagaccgcctggcccgcagcac |
| | | ccgcgacctactggacattgccgagcgcatccaggaggccggcgcgggcc |
| | | tgcgtagcctggcagagccgtgggccgacaccaccacgccggccggccgc |
| | | atggtgttgaccgtgttcgccggcattgccgagttcgagcgttccctaat |
| | | catcgaccgcaccggagcgggcgcgaggccgccaaggcccgaggcgtga |
| | | agtttggccccgccctaccctcaccccggcacagatcgcgcacgcccgc |
| | | gagctgatcgaccaggaaggccgcaccgtgaaagaggcggctgcactgct |
| | | tggcgtgcatcgctcgaccctgtaccgcgcacttgagcgcagcgaggaag |
| | | tgacgcccaccgaggccaggcggcgcggtgccttccgtgaggacgcattg |
| | | accgaggccgacgccctggcggccgccgagaatgaacgcaagaggaaca |
| | | agcatgaaaccgcaccaggacggccaggacgaaccgttttcattaccga |
| | | agagatcgaggcggagatgatcgcggccgggtacgtgttcgagccgcccg |
| | | cgcacgtctcaaccgtgcggctgcatgaaatcctggccggtttgtctgat |
| | | gccaagctggcggcctggccggccagcttggccgctgaagaaaccgagcg |
| | | ccgccgtctaaaaaggtgatgtgtatttgagtaaaacagcttgcgtcatg |
| | | cggtcgctgcgtatatgatgcgatgagtaaataaacaaatacgcaagggg |
| | | aacgcatgaaggttatcgctgtactaaccagaaaggggtcaggcaaga |
| | | cgaccatcgcaacccatctagcccgcgccctgcaactcgccggggccgat |
| | | gttctgttagtcgattccgatccccagggcagtgcccgcgattgggcggc |
| | | cgtgcgggaagatcaaccgctaaccgttgtcggcatcgaccgcccgacga |
| | | ttgaccgcgacgtgaaggccatcggccggcgcgacttcgtagtgatcgac |
| | | ggagcgcccaggcggcggacttggctgtgtccgcgatcaaggcagccga |
| | | cttcgtgctgattccggtgcagccaagcccttacgacatatgggccaccg |
| | | ccgacctggtggagctggttaagcagcgcattgaggtcacggatggaagg |
| | | ctacaagcggcctttgtcgtgtcgcgggcgatcaaaggcacgcgcatcgg |
| | | cggtgaggttgccgagcgctggccgggtacgagctgcccattcttgagt |
| | | cccgtatcacgcagcgcgtgagctacccaggcactgccgccgccggcaca |
| | | accgttcttgaatcagaacccgagggcgacgctgcccgcgaggtccaggc |
| | | gctggccgctgaaattaaatcaaaactcatttgagttaatgaggtaaaga |
| | | gaaaatgagcaaaagcacaaacacgctaagtgccggccgtccgagcgcac |
| | | gcagcagcaaggctgcaacgttggccagcctggcagacacgccagccatg |
| | | aagcgggtcaactttcagttgccggcggaggatcacaccaagctgaagat |
| | | gtacgcggtacgccaaggcaagaccattaccgagctgctatctgaataca |
| | | tcgcgcagctaccagagtaaatgagcaaatgaataaatgagtagatgaat |
| | | tttagcggctaaaggaggcggcatggaaaatcaagaacaaccaggcaccg |
| | | acgccgtggaatgccccatgtgtggaggaacgggcggttggccaggcgta |
| | | agcggctgggttgtctgccggccctgcaatggcactggaaccccccaagcc |
| | | cgaggaatcggcgtgagcggtcgcaaaccatccggcccggtacaaatcgg |
| | | cgcggcgctgggtgatgacctggtggagaagttgaaggccgcgcaggccg |
| | | cccagcggcaacgcatcgaggcagaagcacgcccggtaatcgtggcaa |
| | | gcggccgctgatcgaatccgcaaagaatcccggcaaccgccggcagccgg |
| | | tgcgccgtcgattaggaagccgcccaagggcgacgagcaaccagattttt |
| | | tcgttccgatgctctatgacgtgggcacccgcgatagtcgcagcatcatg |
| | | gacgtggccgttttccgtctgtcgaagcgtgaccgacgagctggcgaggt |
| | | gatccgctacgagcttccagacgggcacgtagaggtttccgcagggccgg |
| | | ccggcatggccagtgtgtgggattacgacctggtactgatggcggtttcc |
| | | catctaaccgaatccatgaaccgataccgggaagggaagggagacaagcc |
| | | cggccgcgtgttccgtccacacgttgcggacgtactcaagttctgccggc |
| | | gagccgatggcggaaagcagaaagacgacctggtagaaacctgcattcgg |
| | | ttaaacaccacgcacgttgccatgcagcgtacgaagaaggccaagaacgg |
| | | ccgcctggtgacggtatccgagggtgaagccttgattagccgctacaaga |
| | | tcgtaaagagcgaaaccgggcggccggagtacatcgagatcgagctagct |
| | | gattggatgtaccgcgagatcacagaaggcaagaacccggacgtgctgac |
| | | ggttcaccccgattactttttgatcgatcccggcatcggccgttttctct |
| | | accgcctggcacgccgcgccgcaggcaaggcagaagccagatggttgttc |
| | | aagacgatctacgaacgcagtggcagcgccggagagttcaagaagttctg |
| | | tttcaccgtgcgcaagctgatcgggtcaaatgacctgccggagtacgatt |
| | | tgaaggaggaggcggggcaggctggcccgatcctagtcatgcgctaccgc |
| | | aacctgatcgagggcgaagcatccgccggttcctaatgtacggagcagat |
| | | gctagggcaaattgccctagcaggggaaaaaggtcgaaaaggtctctttc |
| | | ctgtggatagcacgtacattgggaacccaaagccgtacattgggaaccgg |
| | | aacccgtacattgggaacccaaagccgtacattgggaaccggtcacacat |
| | | gtaagtgactgatataaaagagaaaaaaggcgattttccgcctaaaact |
| | | ctttaaaacttattaaaactcttaaaacccgcctggcctgtgcataactg |
| | | tctggccagcgcacagccgaagagctgcaaaaagcgcctacccttcggtc |
| | | gctgcgctcccctacgccccgccgcttcgcgtcggcctatcgcggccgctg |
| | | gccgctcaaaaatggctggcctacggccaggcaatctaccagggcgcgga |
| | | caagccgcgccgtcgccactcgaccgccggcgcccacatcaaggcaccct |
| | | gcctcgcgcgtttcggtgatgacggtgaaaacctctgacacatgcagctc |
| | | ccggagacggtcacagcttgtctgtaagcggatgccgggagcagacaagc |
| | | ccgtcagggcgcgtcagcgggtgttggcgggtgtcggggcgcagccatga |

TABLE 22-continued

Psilocybin expression vector sequences.

| SEQ ID NO. | Name | Sequence |
|---|---|---|
| | | cccagtcacgtagcgatagcggagtgtatactggcttaactatgcggcat cagagcagattgtactgagagtgcaccatatgcggtgtgaaataccgcac agatgcgtaaggagaaaataccgcatcaggcgctcttccgcttcctcgct cactgactcgctgcgctcggtcgttcggctgcggcgagcggtatcagctc actcaaaggcggtaatacggttatccacagaatcaggggataacgcagga aagaacatgtgagcaaaaggccagcaaaaggccaggaaccgtaaaaaggc cgcgttgctggcgttttccataggctccgcccccctgacgagcatcaca aaaatcgacgctcaagtcagaggtggcgaaacccgacaggactataaaga taccaggcgtttccccctggaagctccctcgtgcgctctcctgttccgac cctgccgcttaccggatacctgtccgcctttctcccttcgggaagcgtgg cgctttctcatagctcacgctgtaggtatctcagttcggtgtaggtcgtt cgctccaagctgggctgtgtgcacgaaccccccgttcagcccgaccgctg cgccttatccggtaactatcgtcttgagtccaacccggtaagacacgact tatcgccactggcagcagccactggtaacaggattagcagagcgaggtat gtaggcggtgctacagagttcttgaagtggtggcctaactacggctacac tagaaggacagtatttggtatctgcgctctgctgaagccagttaccttcg gaaaaagagttggtagctcttgatccggcaaacaaaccaccgctggtagc ggtggtttttttgtttgcaagcagcagattacgcgcagaaaaaaaggatc tcaagaagatcctttgatcttttctacggggtctgacgctcagtggaacg aaaactcacgttaagggattttggtcatgcattctaggtactaaaacaat tcatccagtaaaatataatattttattttctcccaatcaggcttgatccc cagtaagtcaaaaaatagctcgacatactgttcttccccgatatcctccc tgatcgaccggacgcagaaggcaatgtcataccacttgtccgccctgccg cttctcccaagatcaataaagccacttactttgccatctttcacaaagat gttgctgtctcccaggtcgccgtgggaaaagacaagttcctcttcgggct tttccgtctttaaaaaatcatacagctcgcgcggatctttaaatggagtg tcttcttcccagttttcgcaatccacatcggccagatcgttattcagtaa gtaatccaattcggctaagcggctgtctaagctattcgtataggacaat ccgatatgtcgatggagtgaaagagcctgatgcactccgcatacagctcg ataatcttttcagggctttgttcatcttcatactcttccgagcaaaggac gccatcggcctcactcatgagcagattgctccagccatcatgccgttcaa agtgcaggacctttggaacaggcagctttccttccagccatagcatcatg tccttttcccgttccacatcataggtggtccctttataccggctgtccgt catttttaaatataggttttcattttctcccaccagcttatataccttag caggagacattccttccgtatcttttacgcagcggtatttttcgatcagt ttttcaattccggtgatattctcattttagccattattattttccttcc tcttttctacagtatttaaagataccccaagaagctaattataacaagac gaactccaattcactgttccttgcattctaaaaccttaaatacagaaaa cagctttttcaaagttgttttcaaagttggcgtataacatagtatcgacg gagccgattttgaaaccgcggtgatcacaggcagcaacgctctgtcatcg ttacaatcaacatgctaccctcgcgagatcatccgtgtttcaaacccgg cagcttagttgccgttcttccgaatagcatcggtaacatgagcaaagtct gccgccttacaacggctctcccgctgacgccgtcccggactgatgggctg cctgtatcgagtggtgattttgtgccgagctgccggtcggggagctgttg gctggctggtggcaggatatattgtggtgtaaacaaattgacgcttagac aacttaataacacattgcggacgtttttaatgtactgaattaacgccgaa ttaattcggggatctggattttagtactggattttggttttaggaatta gaaatttattgatagaagtattttacaaatacaaatacatactaagggt ttcttatatgctcaacacatgagcgaaacctataggaaccctaattccc ttatctgggaactactcacacattattatggagaaactcgagcttgtcga tcgacagatccggtcggcatctactctattctttgccctcggacgagtg ctggggcgtcggtttccactatcggcgagtacttctacacagccatcggt ccagacggccgcgcttctgcgggcgatttgtgtacgcccgacagtcccgg ctccggatcggacgattgcgtcgcatcgaccctgcgcccaagctgcatca tcgaaattgccgtcaaccaagctctgatagagttggtcaagaccaatgcg gagcatatacgcccggagtcgtggcgatcctgcaagctccggatgcctcc gctcgaagtagcgcgtctgctgctccatacaagccaaccacggcctccag aagaagatgttggcgacctcgtattgggaatccccgaacatcgcctcgct ccagtcaatgaccgctgttatgcggccattgtccgtcaggacattgttgg agccgaaatccgcgtgcacgaggtgccggacttcggggcagtcctcggcc caaagcatcagctcatcgagagcctgcgcgacggacgcactgacggtgtc gtccatcacagtttgccagtgatacacatggggatcagcaatcgcgcata tgaaatcacgccatgtagtgtattgaccgattccttgcggtccgaatggg ccgaacccgctcgtctggctaagatcggccgcagcgatcgcatccatagc ctccgcgaccggttgtagaacagcgggcagttcggtttcaggcaggtctt gcaacgtgacaccctgtgcacggcgggagatgcaataggtcaggctctcg ctaaactccccaatgtcaagcacttccggaatcgggagcgcggccgatgc aaagtgccgataaacataacgatctttgtagaaaccatcggcgcagctat ttacccgcaggacatatccacgccctcctacatcgaagctgaaagcacga gattcttcgccctccgagagctgcatcaggtcggagacgctgtcgaactt ttcgatcagaaacttctcgacagacgtcgcggtgagttcaggcttttca tatctcattgccccccgggatctgcgaaagctcgagagagatagatttgt agagagagactggtgatttcagcgtgtcctctccaaatgaaatgaacttc cttatatagaggaaggtcttgcgaaggatagtgggattgtgcgtcatccc |

TABLE 22-continued

Psilocybin expression vector sequences.

| SEQ ID NO. | Name | Sequence |
|---|---|---|
| | | ttacgtcagtggagatatcacatcaatccacttgctttgaagacgtggtt<br>ggaacgtcttcttttccacgatgctcctcgtgggggggtccatctttg<br>ggaccactgtcggcagaggcatcttgaacgatagcctttcctttatcgca<br>atgatggcatttgtaggtgccaccttccttttctactgtccttttgatga<br>agtgacagatagctgggcaatggaatccgaggaggtttcccgatattacc<br>ctttgttgaaaagtctcaatagcccttggtcttctgagactgtatcttt<br>gatattcttggagtagacgagagtgtcgtgctccaccatgttatcacatc<br>aatccacttgctttgaagacgtggttggaacgtcttctttttccacgatg<br>ctcctcgtgggggggtccatctttgggaccactgtcggcagaggcatct<br>tgaacgatagcctttcctttatcgcaatgatggcatttgtaggtgccacc<br>ttccttttctactgtccttttgatgaagtgacagatagctgggcaatgga<br>atccgaggaggtttcccgatattaccctttgttgaaaagtctcaatagcc<br>ctttggtcttctgagactgtatctttgatattcttggagtagacgagagt<br>gtcgtgctccaccatgttggcaagctgctctagccaatacgcaaaccgcc<br>tctccccgcgcgttggccgattcattaatgcagctggcacgacaggtttc<br>ccgactggaaagcgggcagtgagcgcaacgcaattaatgtgagttagctc<br>actcattaggcaccccaggctttacactttatgcttccggctcgtatgtt<br>gtgtggaattgtgagcggataacaatttcacacaggaaacagctatgacc<br>atgattacg |

In some embodiments, the engineered fungus comprises a concentration of psilocybin that is at least 10% greater than a concentration of psilocybin in a comparable fungus devoid of said genetic modification. The engineered fungus can be selected from the group consisting of Psilocybe, Conocybe, Gyranopilus, Panaeolus, Pluteus, and Stropharia. In some instances, the engineered fungus includes one or more transgenes are selected from the group consisting of (i) PsiD, (ii) PsiD and PsiK, (iii) PsiD, PsiK, PsiM, and (iv) PsiD, PsiK, PsiM, PsiH.

In one aspect, this disclosure provides a method comprising introducing an exogenous nucleic acid encoding L-tryptophan decarboxylase into a fungal cell; growing the fungal cell into a mycelial mass; and expressing L-tryptophan decarboxylase in the mycelial mass, wherein the presence of the exogenous nucleic acid results in an increased level of L-tryptophan decarboxylase expression in the mycelial mass expressing as compared to a comparable wild-type mycelial mass. For example, the fungal cell can be a fungal protoplast, such as, a fungal protoplast is from division Basidiomycota.

In some embodiments, the expression of L-tryptophan decarboxylase results in the mycelial mass comprising a phenotype that is visually distinct from a phenotype of a comparable mycelial mass that is devoid of said genetic modification, wherein the phenotype comprises a color of blue. The mycelial mass, by virtue of overexpress L-tryptophan decarboxylase, may reflects a wavelength of light that is between 450 and 500 nanometers. In some instances, the mycelial mass has a concentration of psilocybin that is greater than 1.7% as measured by dry mycelial mass.

In one, provided herein is a method comprising: obtaining a genetically modified organism comprising a genetic modification, wherein the genetic modification results in increased expression of L-tryptophan decarboxylase as compared to a comparable organism without said genetic modification; detecting, from a tissue of the genetically modified organism, a change from a first color to a second color upon exposure of the tissue to air, wherein the second color is visually distinct from tissue of a comparable organism upon an equivalent exposure of air. For example, the change to the second color occurs within 5 minutes. The second color can include a reflected wavelength of light that is between 450 and 500 nanometers.

In some embodiments, an exogenous nucleic acid is delivered into an organism, wherein the exogenous nucleic acid encodes one or more genes to be expressed inside the organism. In some embodiments, the one or more genes are driven by a promoter having high promoter activity for a fungal cell. In some embodiments, the promoter comprises one of a U6 promoter or a GDP promoter. For example, in some embodiments a promoter is selected from a promoter sequence described in TABLE 20B. For example, in some embodiments a promoter is selected from:

pU6-1 promoter:
(SEQ ID NO: 250)
CGATTTCTTTAGGGCCGTAGGCTAGTAATCATCGACCGTT

TTAATCATTAATGTACTTAGACAATAAATATAAGATGCAA

TACAAGTCAATGGGAGAAACTAGACTTTACAAAACCTTTA

AAAGCCCTGGTGAGATATGAGAAGGTTTATGACAGAATAT

ATCGCCATTAATGTGAGGTTGTGGACACTGCTGGTAGTCA

AGGCTGCCCGTGAACCATATTTAGTCACATGTAATCACCC

CGCGTGCTAAACAAAAAGCAAAATATCAGTAAGATAGTCA

CAGTCATAACACTGTTGAAT

>pU6-2 promoter:
(SEQ ID NO: 251)
TGCCAAAAAGCCTTCTTGTGGCCTGCTTACTATTAAGGCA

ACTAATTCAAGAACAAGTGATTCTGGGTAGGTAGATGCCA

CAGTTCATGATAATAAAGGCGAAGTCAGAAGGAGTAGTCC

GTTGATGAAGAAAGCAGAAGGCAAGGAATGTTGGTGGCTT

TTGGTTGCGGTAGCACTGAAACCGTGTCCGGACTTCGCCG

GGAGCAGACAATGGCTTGGTTGGATTACATAATAATACCC pU6-11 promoter:

(SEQ ID NO: 252)
GGTACCAGCAGTACCAGCACCAGCCACTGCATTATTGAAT

CTGACATCTGCAACAGCAAGGTACAATTTTTGTTTTACAT

TTTACTCATTAATATTAGCACCTATAGCTGTGGCCAATCT

TTTGACGACGACTCTCTCACGCTGGAGGAAAGCATGGTAC

GGGCATTAATTGCCAGCGTAGAACAAGCGTAGGATATGGG

CAACCTCGCTGATTTCTATATTTGGTAAGAAGTCTCACCC

CGTGAGCTAAGCAAAAAGCAAAACCCTTGCTATGTCAACA

TCCCACTGCCATACACTATT

In some embodiments, a GDP promoter is used. The GDP promoter can have sequences (SEQ ID NO: 253)
GAGCTCTGAAAGACGCAGCCGACGGTAAACACCCGGGCAT

CGAGAAAGGCATTGTCGACTATACGGAAGAAGACGTTGTT

TCCACCGATTTCGTTGGGAGCAACTATTCGATGATCTTTG

ACGCAAAAGCGGGCATCGCGTTGAACTCGCGTTTTATGAA

ATTAGTTGCATGGTATGATAATGAGTGGGGATATGCGCGT

AGAGTCTGCGATGAGGTTGTGTATGTAGCGAAGAAGAATT

AAGAGGTCCGCAAGTAGATTGAAAGTTCAGTACGTTTTTA

ACAATAGAGCATTTTCGAGGCTTGCGTCATTCTGTGTCAG

GCTAGCAGTTTATAAGCGTTGAGGATCTAGAGCTGCTGTT

CCCGCGTCTCGAATGTTCTCGGTGTTTAGGGGTTAGCAAT

CTGATATGATAATAATTTGTGATGACATCGATAGTACAAA

AACCCCAATTCCGGTCACATCCACCATCTCCGTTTTCTCC

CATCTACACACAACAAGCTCATCGCCggtaccATGGTTTG

TCTCTCGCTTGCATACCACCCAGCAGCTCACTGATGTCGA

CTTGTAGGTTAAA

In some embodiments, the exogenous nucleic acid comprises a start intron between the promoter and the gene to be expressed. In some embodiments, the start intron comprises (SEQ ID NO: 254)
ATGGTTTGTCTCTCGCTTGCATACCACCCAGCAGCTCACT

GATGTCGACTTGTAGGTTAAA.

In some embodiments, genetically modifying an organism involves introducing an exogenous nucleic acid into the organism. In some embodiments, the exogenous nucleic acid encodes PsiM. In some embodiments, the PsiM gene is codon optimized. In some embodiments, the codon optimized PsiM is driven by a GPD promoter. In some embodiments, the exogenous nucleic acid comprises a sequence that is at least 50%, at least 55%, at least 60%, at least 65%, at least 70%, at least 75%, at least 80%, at least 85%, at least 90%, at least 95%, or at least 100% identical to SEQ ID NO: 500.

In some embodiments, the exogenous nucleic acid encodes an aromatic L-amino acid decarboxylase (AAAD) gene from *P. cubensis*. In some embodiments, the AAAD is codon optimized for expression in *P. cubensis*. In some embodiments, the AAAD gene is driven by a GPD promoter. In some embodiments, the exogenous nucleic acid comprises a sequence that is at least 50%, at least 55%, at least 60%, at least 65%, at least 70%, at least 75%, at least 80%, at least 85%, at least 90%, at least 95%, or at least 100% identical to SEQ ID NO: 501.

In an aspect, the methods can comprise culturing the mycelial mass under conditions sufficient for the population of genetically modified fungal cells to grow and extracting the alkaloid from the population of fungal cells prior primordia formation on the mycelial mass. All of the fungal cells in the population of fungal cells can be genetically modified fungal cells. The mycelial mass may not comprise primordial fungal cells. The mycelial mass can be cultured for less than 10 days. The population of fungal cells can be from division Basidiomycota. The alkaloid can be extracted from the population of fungal cells within 7 days of culturing the mycelial mass. The culturing of the mycelial mass can comprise depositing the mycelial mass into an enclosure and providing the enclosure with a climate comprising a temperature of about 19 to 25 degrees Celsius and about 90 to 100% humidity. The amount of the alkaloid extracted from the population of fungal cells can be greater than 1.8% of dry mycelial mass. The alkaloid can comprise any one of psilocybin, norpsilocin, psilocin, tryptamine, 4-hydroxytryptamine, N,N-dimethyltryptamine, baeocystin, norbaeocystin, serotonin, melatonin, melanin, N-acetyl-hydroxytryptamine, 4-hydroxy-L-tryptophan, 5-hydroxy-L-tryptophan, 7-hydroxy-L-tryptophan, 4-phosphoryloxy-N,N-dimethyltryptamine, serotonin, aeruginascin, 2-(4-Hydroxy-1H-indol-3-yl)-N,N,N-trimethylethan-1-aminium, 4-phosphoryloxy-N,N-dimethyltryptamine, ketamine, normelatonin, 3,4-methylenedioxymethamphetamine, harmine, β-carboline, or any derivative or any analogue thereof. The genetic modification can result in increased expression of a monoamine oxidase. The alkaloid can comprise N,N-dimethyltryptamine. The genetic modification can result in an increased expression of a gene product involved in biosynthesis of the alkaloid in the population of fungal cells as compared to comparable wild-type population of fungal cells. The gene product can be encoded by a gene selected from PsiD, PsiH, PsiH2, PsiK, PsiM, PsiP, and PsiR, and wherein the gene comprises a sequence that is at least 95% identical to any one of SEQ ID NOS: 1-16. The population of fungal cells can comprise at least two genetic modifications. In some embodiments, at least one of the at least two genetic modification can result in the increased expression of a gene product encoded by at least one gene selected from PsiD, PsiH, PsiH2, PsiK, PsiM, PsiP, and PsiR, and wherein the gene comprises a sequence that is at least 95% identical to any one of SEQ ID NOS: 1-16. In some embodiments, at least one of the at least two genetic modification can result in the increased expression of a gene product encoded by at least one gene selected from PsiD and PsiK, and wherein the genes comprise sequences that are at least 95% identical to SEQ ID NO: 1 and SEQ ID NO: 3. In some embodiments, at least one of the at least two genetic modification can result in the increased expression of a gene product encoded by at least one gene selected from PsiD and PsiK, and wherein the genes comprise sequences that are at least 95% identical to SEQ ID NO: 90 and SEQ ID NO: 3. The genetic modification can comprise a deletion of a nucleotide in a nucleic acid involved in expression of a gene product that modulates production of the alkaloid in the population of fungal cells. The genetic modification can comprise an indel within a promoter or an enhancer of a gene that encodes psilocybin phosphatase. The genetic modification can result in an increased expression of L-tryptophan decarboxylase and 4-hydroxytryptamine kinase as compared to a comparable wild-type population of fungal cells. The genetic modification can result in an increased expression of a tryptamine monooxygenase as compared to comparable wild-type population of fungal cells. The mycelial mass can exhibit a phenotype that is visually distinct from a comparable wild-type mycelial mass. The phenotype can comprise a blue coloration. The genetic modification can result in at least one of increased tryptophan decarboxylation, increased tryptamine 4-hydroxylation, increased 4-hydroxytryptamine O-phosphorylation, or increased psilocybin production via sequential N-methylations as compared to a comparable population of wild-type fungal cells. The genetic modification can result in a 6-fold increase in expression of a gene product by the population of fungal cells as compared to a comparable wild-type population of fungal cells. The population of fungal cells can further comprise a second genetic modification that results in at least one of increased tryptamine 4-hydroxylation, increased 4-hydroxytryptamine O-phosphorylation, or increased psilocybin production via sequential N-methylations as compared to a comparable wild-type population of fungal cells. The extraction can occur when the mycelial mass comprises a blue coloration. Obtaining the mycelial mass can comprise genetically modifying a fungal protoplast and culturing the genetically modified fungal protoplast to generate the population of fungal cells. Genetically modifying the fungal protoplast can comprise integrating an exogenous nucleic acid into the genome of the fungal protoplast. The exogenous nucleic acid can comprise a gene encoding a gene product that is involved in biosynthesis of the alkaloid, wherein the gene is selected from PsiM, PsiH, PsiH2, PsiK, PsiM, PsiR, or a variant thereof. The exogenous nucleic acid can comprise a sequence that is at least 95% identical to any one of SEQ ID NOS 1-16. Genetically modifying the fungal protoplast can comprise delivering an exogenous nucleic acid into the fugal protoplast by electroporation, microinjection, mechanical cell deformation, a lipid nanoparticle, a lentivirus, or agrobacterium mediated transformation. The genetic modification can be accomplished by an endonuclease system. The endonuclease system can comprise an endonuclease complexed with guide nucleic acid. The endonuclease can comprise a Cas endonuclease and the nucleic acid comprises a guide RNA. The guide RNA can comprise a targeting sequence that has a 95% identity to any one of SEQ ID NOS: 29-64. The population of fungal cells can comprise an increased expression of L-tryptophan decarboxylase as compared to a comparable wild-type population of fungal cells. The mycelial mass can reflect light having a wavelength of between about 425 and 525 nanometers.

Disclosed herein is a method for enhanced alkaloid production, the method comprising: obtaining a genetically modified fungal cell, wherein the genetically modified fungal cell can produce an increased amount of one or more alkaloids as compared to a comparable wild-type fungal cell, generating a mycelial mass under conditions sufficient for a population of genetically modified fungal cells to grow, wherein the mycelial mass comprises a phenotype that is visually distinct from a phenotype of a comparable wild-type mycelial mass; and isolating the one or more alkaloids from the mycelial mass. The phenotype can comprise a blue coloration. The phenotype that is visibly distinct can be observed by a greater amount of reflected light at a wavelength range of 400 to 510 nm. The phenotype that is visibly distinct can be observed by a greater amount of reflected light at a wavelength range of 445 to 510 nm. The phenotype that is visibly distinct can be observed by a greater amount of reflected light at a wavelength range of 400 to 475 nm. The one or more alkaloids can be isolated from the mycelial mass prior to formation of primordia. The fungal cell can be a fungal protoplast. The genetic modification can result in at least a 2-fold increase in expression of mRNA encoding L-tryptophan decarboxylase in the mycelial mass as compared to a comparable wild-type mycelial mass. The genetic modification can result in an increased production of L-tryptophan decarboxylase and 4-hydroxytryptamine kinase as compared to a comparable wild-type mycelial mass. The genetic modification can provide for increased mRNA expression of the following genes: PsiD and PsiK. The genetic modification can provide for increased production of a protein encoded by the following genes: PsiD and PsiK. Genetically modifying the fungal cell can comprise introducing an exogenous nucleic acid into the fungal cell. The exogenous nucleic acid can encode an endonuclease system. The endonuclease system can comprise a Cas endonuclease and a guide nucleic acid. The exogenous nucleic acid can encode a gene product involved in biosynthesis of at least one of the one or more alkaloids. The exogenous nucleic acid can comprise a sequence that is 95% identical to any one of SEQ ID NOS: 1-16. The mycelial mass can comprise a modification that results in one of increased tryptamine 4-hydroxylation, increased 4-hydroxytryptamine O-phosphorylation, or increased psilocybin production via sequential N-methylations as compared to a comparable wild-type mycelial mass. The mycelial mass can comprise an altered expression of a gene product encoded by any one of PsiD, PsiM, PsiH, PsiH2, PsiK, PsiM or PsiR, as compared to a comparable wild-type mycelial mass. The fungal mycelium can reflect light having a wavelength of between about 450 and 500 nanometers. Genetically modifying the fungal cell can comprise introducing an endonuclease system into the fungal cell. The endonuclease system can comprise a Cas endonuclease complexed with a guide nucleic acid. The guide nucleic acid can comprise a targeting sequence that binds to a regulatory element of a gene encoding a gene product involved in psilocybin synthesis. The gene can comprise one of PsiD, PsiH, PsiH2, PsiK, PsiM, PsiP, or PsiR. The targeting sequence can comprise a sequence that has a 95% identity to any one of SEQ ID NOS: 1-16. The endonuclease system can be introduced into the fungal cell in the form of a ribonucleoprotein. The endonuclease system can be introduced into the fungal cell using a chemical reagent. The chemical reagent can comprise a detergent. The one or more alkaloids can comprise at least one of psilocybin, norpsilocin, psilocin, tryptamine, 4-hydroxytryptamine, N,N-dimethyltryptamine, baeocystin, norbaeocystin, serotonin, melatonin, melanin, N-acetyl-hydroxytryptamine, 4-hydroxy-L-tryptophan, 5-hydroxy-L-tryptophan, 7-hydroxy-L-tryptophan, 4-phosphoryloxy-N,N-dimethyltryptamine, serotonin, aeruginascin, 2-(4-Hydroxy-1H-indol-3-yl)-N,N,N-trimethylethan-1-aminium, 4-phosphoryloxy-N,N-dimethyltryptamine, ketamine, normelatonin, 3,4-methylenedioxymethamphetamine, harmine, β-carboline, or any derivative or any analogue thereof.

Disclosed herein is a composition comprising a mycelial mass, isolate, or extract thereof further comprising a population of fungal cells wherein the population of fungal cells comprises at least one genetic modification that results in a population of genetically modified fungal cells producing an increased amount of an alkaloid as compared to a comparable wild-type population of fungal cells, wherein the mycelial mass lacks detectable expression of a gene product encoded by PsiR, and wherein the mycelial mass has not formed fungal primordia. All of the fungal cells in the population of fungal cells can be genetically modified fungal cells. The mycelial mass may not comprise primordial fungal cells. The mycelial mass can be cultured for less than 10 days. The population of fungal cells can be from division Basidiomycota. The alkaloid can be extracted from the population of fungal cells within 7 days of culturing the mycelial mass. The culturing of the mycelial mass can comprise depositing the mycelial mass into an enclosure and providing the enclosure with a climate comprising a temperature of about 19 to 25 degrees Celsius and about 90 to 100% humidity. The amount of the alkaloid extracted from the population of fungal cells can be greater than 1.8% of dry mycelial mass. The alkaloid can comprise any one of psilocybin, norpsilocin, psilocin, tryptamine, 4-hydroxytryptamine, N,N-dimethyltryptamine, baeocystin, norbaeocystin, serotonin, melatonin, melanin, N-acetyl-hydroxytryptamine, 4-hydroxy-L-tryptophan, 5-hydroxy-L-tryptophan, 7-hydroxy-L-tryptophan, 4-phosphoryloxy-N,N-dimethyltryptamine, serotonin, aeruginascin, 2-(4-Hydroxy-1H-indol-3-yl)-N,N,N-trimethylethan-1-aminium, 4-phosphoryloxy-N,N-dimethyltryptamine, ketamine, normelatonin, 3,4-methylenedioxymethamphetamine, harmine, β-carboline, or any derivative or any analogue thereof. The genetic modification can result in increased expression of a monoamine oxidase. The alkaloid can comprise N,N-dimethyltryptamine. The genetic modification can result in an increased expression of a gene product involved in biosynthesis of the alkaloid in the population of fungal cells as compared to comparable wild-type population of fungal cells. The gene product can be encoded by a gene selected from PsiD, PsiH, PsiH2, PsiK, PsiM, PsiP, and PsiR, and wherein the gene comprises a sequence that is at least 95% identical to any one of SEQ ID NOS: 1-16. The population of fungal cells can comprise at least two genetic modifications. In some embodiments, at least one of the at least two genetic modification can result in the increased expression of a gene product encoded by at least one gene selected from PsiD, PsiH, PsiH2, PsiK, PsiM, PsiP, and PsiR, and wherein the gene comprises a sequence that is at least 95% identical to any one of SEQ ID NOS: 1-16. In some embodiments, at least one of the at least two genetic modification can result in the increased expression of a gene product encoded by at least one gene selected from PsiD and PsiK, and wherein the genes comprise sequences that are at least 95% identical to SEQ ID NO: 1 and SEQ ID NO: 3. The genetic modification can comprise a deletion of a nucleotide in a nucleic acid involved in expression of a gene product that modulates production of the alkaloid in the population of fungal cells. The genetic modification can comprise an indel within a promoter or an enhancer of a gene that encodes psilocybin phosphatase. The genetic modification can result in an increased expression of L-tryptophan decarboxylase and 4-hydroxytryptamine kinase as compared to a comparable wild-type population of fungal cells. The genetic modification can result in an increased expression of a tryptamine monooxygenase as compared to comparable wild-type population of fungal cells. The genetic modification can result in at least a 2-fold increase in expression of mRNA encoding L-tryptophan decarboxylase in the mycelial mass as compared to a comparable wild-type mycelial mass. The genetic modification can result in an increased expression of L-tryptophan decarboxylase and 4-hydroxytryptamine kinase as compared to a comparable wild-type mycelial mass. The genetic modification can comprise multiple gene products encoded by PsiD and PsiK. The genetic modification can result in an increased expression of a tryptamine monooxygenase as compared to comparable wild-type population of fungal cells. The mycelial mass can exhibit a phenotype that is visually distinct from a comparable wild-type mycelial mass. The phenotype can comprise a blue coloration. The mycelial mass can reflect light having a wavelength of between about 425 and 525 nanometers. The phenotype that is visibly distinct can be observed by a greater amount of reflected light at a wavelength range of 400 to 510 nm. The phenotype that is visibly distinct can be observed by a greater amount of reflected light at a wavelength range of 445 to 510 nm. The phenotype that is visibly distinct can be observed by a greater amount of reflected light at a wavelength range of 400 to 475 nm. The one or more alkaloids can be isolated from the mycelial mass prior to formation of primordia. The genetic modification can result in at least one of increased tryptophan decarboxylation, increased tryptamine 4-hydroxylation, increased 4-hydroxytryptamine O-phosphorylation, or increased psilocybin production via sequential N-methylations as compared to a comparable population of wild-type fungal cells. The genetic modification can result in a 6-fold increase in expression of a gene product by the population of fungal cells as compared to a comparable wild-type population of fungal cells. The population of fungal cells can further comprise a second genetic modification that results in at least one of increased tryptamine 4-hydroxylation, increased 4-hydroxytryptamine O-phosphorylation, or increased psilocybin production via sequential N-methylations as compared to a comparable wild-type population of fungal cells. The extraction can occur when the mycelial mass comprises a blue coloration. Obtaining the mycelial mass can comprise genetically modifying a fungal protoplast and culturing the genetically modified fungal protoplast to generate the population of fungal cells. Genetically modifying the fungal protoplast can comprise integrating an exogenous nucleic acid into the genome of the fungal protoplast. The exogenous nucleic acid can comprise a gene encoding a gene product that is involved in biosynthesis of the alkaloid, wherein the gene is selected from PsiM, PsiH, PsiH2, PsiK, PsiM, PsiR, or a variant thereof. The exogenous nucleic acid can comprise a sequence that is at least 95% identical to any one of SEQ ID NOS 1-16. Genetically modifying the fungal protoplast can comprise delivering an exogenous nucleic acid into the fugal protoplast by electroporation, microinjection, mechanical cell deformation, a lipid nanoparticle, a lentivirus, or *agrobacterium* mediated transformation. The genetic modification can be accomplished by an endonuclease system. The endonuclease system can comprise an endonuclease complexed with guide nucleic acid. The endonuclease can comprise a Cas endonuclease and the nucleic acid comprises a guide RNA. The guide RNA can comprise a targeting sequence that has a 95% identity to any one of SEQ ID NOS: 29-64. The population of fungal cells can comprise an increased expression of L-tryptophan decarboxylase as compared to a comparable wild-type population of fungal cells.

Disclosed herein is a composition comprising: a mycelial mass, wherein the mycelial mass comprises a population of fungal cells, wherein the fungal cells comprise a genetic modification to a gene encoding for a gene encoding for a gene product involved in the psilocybin biosynthesis, and wherein the genetic modification results in the mycelial mass to be visibly blue in color. All of the fungal cells in the population of fungal cells can be genetically modified fungal cells. The mycelial mass may not comprise primordial fungal cells. The mycelial mass can be cultured for less than 10 days. The population of fungal cells can be from division Basidiomycota. The alkaloid can be extracted from the population of fungal cells within 7 days of culturing the mycelial mass. The culturing of the mycelial mass can comprise depositing the mycelial mass into an enclosure and providing the enclosure with a climate comprising a temperature of about 19 to 25 degrees Celsius and about 90 to 100% humidity. The amount of the alkaloid extracted from the population of fungal cells can be greater than 1.8% of dry mycelial mass. The alkaloid can comprise any one of psilocybin, norpsilocin, psilocin, tryptamine, 4-hydroxytryptamine, N,N-dimethyltryptamine, baeocystin, nor-baeocystin, serotonin, melatonin, melanin, N-acetyl-hydroxytryptamine, 4-hydroxy-L-tryptophan, 5-hydroxy-L-tryptophan, 7-hydroxy-L-tryptophan, 4-phosphoryloxy-N,N-dimethyltryptamine, serotonin, aeruginascin, 2-(4-Hydroxy-1H-indol-3-yl)-N,N,N-trimethylethan-1-aminium, 4-phosphoryloxy-N,N-dimethyltryptamine, ketamine, normelatonin, 3,4-methylenedioxymethamphetamine, harmine, β-carboline, or any derivative or any analogue thereof. The genetic modification can result in increased expression of a monoamine oxidase. The alkaloid can comprise N,N-dimethyltryptamine. The genetic modification can result in an increased expression of a gene product involved in biosynthesis of the alkaloid in the population of fungal cells as compared to comparable wild-type population of fungal cells. The gene product can be encoded by a gene selected from PsiD, PsiH, PsiH2, PsiK, PsiM, PsiP, and PsiR, and wherein the gene comprises a sequence that is at least 95% identical to any one of SEQ ID NOS: 1-16. The population of fungal cells can comprise at least two genetic modifications. In some embodiments, at least one of the at least two genetic modification can result in the increased expression of a gene product encoded by at least one gene selected from PsiD, PsiH, PsiH2, PsiK, PsiM, PsiP, and PsiR, and wherein the gene comprises a sequence that is at least 95% identical to any one of SEQ ID NOS: 1-16. In some embodiments, at least one of the at least two genetic modification can result in the increased expression of a gene product encoded by at least one gene selected from PsiD and PsiK, and wherein the genes comprise sequences that are at least 95% identical to SEQ ID NO: 1 and SEQ ID NO: 3. The genetic modification can comprise a deletion of a nucleotide in a nucleic acid involved in expression of a gene product that modulates production of the alkaloid in the population of fungal cells. The genetic modification can comprise an indel within a promoter or an enhancer of a gene that encodes psilocybin phosphatase. The genetic modification can result in an increased expression of L-tryptophan decarboxylase and 4-hydroxytryptamine kinase as compared to a comparable wild-type population of fungal cells. The genetic modification can result in an increased expression of a tryptamine monooxygenase as compared to comparable wild-type population of fungal cells. The genetic modification can result in at least a 2-fold increase in expression of mRNA encoding L-tryptophan decarboxylase in the mycelial mass as compared to a comparable wild-type mycelial mass. The genetic modification can result in an increased expression of L-tryptophan decarboxylase and 4-hydroxytryptamine kinase as compared to a comparable wild-type mycelial mass. The genetic modification can comprise multiple gene products encoded by PsiD and PsiK. The genetic modification can result in an increased expression of a tryptamine monooxygenase as compared to comparable wild-type population of fungal cells. The mycelial mass can exhibit a phenotype that is visually distinct from a comparable wild-type mycelial mass. The phenotype can comprise a blue coloration. The mycelial mass can reflect light having a wavelength of between about 425 and 525 nanometers. The phenotype that is visibly distinct can be observed by a greater amount of reflected light at a wavelength range of 400 to 510 nm. The phenotype that is visibly distinct can be observed by a greater amount of reflected light at a wavelength range of 445 to 510 nm. The phenotype that is visibly distinct can be observed by a greater amount of reflected light at a wavelength range of 400 to 475 nm. The one or more alkaloids can be isolated from the mycelial mass prior to formation of primordia. The one or more alkaloids can be isolated from the mycelial mass prior to formation of primordia. The genetic modification can result in at least one of increased tryptophan decarboxylation, increased tryptamine 4-hydroxylation, increased 4-hydroxytryptamine O-phosphorylation, or increased psilocybin production via sequential N-methylations as compared to a comparable population of wild-type fungal cells. The genetic modification can result in a 6-fold increase in expression of a gene product by the population of fungal cells as compared to a comparable wild-type population of fungal cells. The population of fungal cells can further comprise a second genetic modification that results in at least one of increased tryptamine 4-hydroxylation, increased 4-hydroxytryptamine O-phosphorylation, or increased psilocybin production via sequential N-methylations as compared to a comparable wild-type population of fungal cells. The extraction can occur when the mycelial mass comprises a blue coloration. Obtaining the mycelial mass can comprise genetically modifying a fungal protoplast and culturing the genetically modified fungal protoplast to generate the population of fungal cells. Genetically modifying the fungal protoplast can comprise integrating an exogenous nucleic acid into the genome of the fungal protoplast. The exogenous nucleic acid can comprise a gene encoding a gene product that is involved in biosynthesis of the alkaloid, wherein the gene is selected from PsiM, PsiH, PsiH2, PsiK, PsiM, PsiR, or a variant thereof. The exogenous nucleic acid can comprise a sequence that is at least 95% identical to any one of SEQ ID NOS 1-16. Genetically modifying the fungal protoplast can comprise delivering an exogenous nucleic acid into the fugal protoplast by electroporation, microinjection, mechanical cell deformation, a lipid nanoparticle, a lentivirus, or *agrobacterium* mediated transformation. The genetic modification can be accomplished by an endonuclease system. The endonuclease system can comprise an endonuclease complexed with guide nucleic acid. The endonuclease can comprise a Cas endonuclease and the nucleic acid comprises a guide RNA. The guide RNA can comprise a targeting sequence that has a 95% identity to any one of SEQ ID NOS: 29-64. The population of fungal cells can comprise an increased expression of L-tryptophan decarboxylase as compared to a comparable wild-type population of fungal cells.

A composition, wherein the composition comprises: a mycelial mass, wherein the mycelial mass comprises a population of genetically modified fungal cells, and wherein the mycelial mass comprises an enhanced level of psilocin in an amount sufficient for the mycelial mass to be visibly blue in color. The genetically modified fungal cells can comprise a genetic modification that provides for an increased amount of an alkaloid produced as compared to a comparable wild-type population of fungal cells, and wherein the mycelial mass is visibly blue in color. All of the fungal cells in the population of fungal cells can be genetically modified fungal cells. The mycelial mass may not comprise primordial fungal cells. The mycelial mass can be cultured for less than 10 days. The population of fungal cells can be from division Basidiomycota. The alkaloid can be extracted from the population of fungal cells within 7 days of culturing the mycelial mass. The culturing of the mycelial mass can comprise depositing the mycelial mass into an enclosure and providing the enclosure with a climate comprising a temperature of about 19 to 25 degrees Celsius and about 90 to 100% humidity. The amount of the alkaloid extracted from the population of fungal cells can be greater than 1.8% of dry mycelial mass. The alkaloid can comprise any one of psilocybin, norpsilocin, psilocin, tryptamine, 4-hydroxytryptamine, N,N-dimethyltryptamine, baeocystin, norbaeocystin, serotonin, melatonin, melanin, N-acetyl-hydroxytryptamine, 4-hydroxy-L-tryptophan, 5-hydroxy-L-tryptophan, 7-hydroxy-L-tryptophan, 4-phosphoryloxy-N,N-dimethyltryptamine, serotonin, aeruginascin, 2-(4-Hydroxy-1H-indol-3-yl)-N,N,N-trimethylethan-1-aminium, 4-phosphoryloxy-N,N-dimethyltryptamine, ketamine, normelatonin, 3,4-methylenedioxymethamphetamine, harmine, β-carboline, or any derivative or any analogue thereof. The genetic modification can result in increased expression of a monoamine oxidase. The alkaloid can comprise N,N-dimethyltryptamine. The genetic modification can result in an increased expression of a gene product involved in biosynthesis of the alkaloid in the population of fungal cells as compared to comparable wild-type population of fungal cells. The gene product can be encoded by a gene selected from PsiD, PsiH, PsiH2, PsiK, PsiM, PsiP, and PsiR, and wherein the gene comprises a sequence that is at least 95% identical to any one of SEQ ID NOS: 1-16. The population of fungal cells can comprise at least two genetic modifications. In some embodiments, at least one of the at least two genetic modification can result in the increased expression of a gene product encoded by at least one gene selected from PsiD, PsiH, PsiH2, PsiK, PsiM, PsiP, and PsiR, and wherein the gene comprises a sequence that is at least 95% identical to any one of SEQ ID NOS: 1-16. In some embodiments, at least one of the at least two genetic modification can result in the increased expression of a gene product encoded by at least one gene selected from PsiD and PsiK, and wherein the genes comprise sequences that are at least 95% identical to SEQ ID NO: 1 and SEQ ID NO: 3. The genetic modification can comprise a deletion of a nucleotide in a nucleic acid involved in expression of a gene product that modulates production of the alkaloid in the population of fungal cells. The genetic modification can comprise an indel within a promoter or an enhancer of a gene that encodes psilocybin phosphatase. The genetic modification can result in an increased expression of L-tryptophan decarboxylase and 4-hydroxytryptamine kinase as compared to a comparable wild-type population of fungal cells. The genetic modification can result in an increased expression of a tryptamine monooxygenase as compared to comparable wild-type population of fungal cells. The genetic modification can result in at least a 2-fold increase in expression of mRNA encoding L-tryptophan decarboxylase in the mycelial mass as compared to a comparable wild-type mycelial mass. The genetic modification can result in an increased expression of L-tryptophan decarboxylase and 4-hydroxytryptamine kinase as compared to a comparable wild-type mycelial mass. The genetic modification can comprise multiple gene products encoded by PsiD and PsiK. The genetic modification can result in an increased expression of a tryptamine monooxygenase as compared to comparable wild-type population of fungal cells. The mycelial mass can exhibit a phenotype that is visually distinct from a comparable wild-type mycelial mass. The phenotype can comprise a blue coloration. The mycelial mass can reflect light having a wavelength of between about 425 and 525 nanometers. The phenotype that is visibly distinct can be observed by a greater amount of reflected light at a wavelength range of 400 to 510 nm. The phenotype that is visibly distinct can be observed by a greater amount of reflected light at a wavelength range of 445 to 510 nm. The phenotype that is visibly distinct can be observed by a greater amount of reflected light at a wavelength range of 400 to 475 nm. The one or more alkaloids can be isolated from the mycelial mass prior to formation of primordia. The genetic modification can result in at least one of increased tryptophan decarboxylation, increased tryptamine 4-hydroxylation, increased 4-hydroxytryptamine O-phosphorylation, or increased psilocybin production via sequential N-methylations as compared to a comparable population of wild-type fungal cells. The genetic modification can result in a 6-fold increase in expression of a gene product by the population of fungal cells as compared to a comparable wild-type population of fungal cells. The population of fungal cells can further comprise a second genetic modification that results in at least one of increased tryptamine 4-hydroxylation, increased 4-hydroxytryptamine O-phosphorylation, or increased psilocybin production via sequential N-methylations as compared to a comparable wild-type population of fungal cells. The extraction can occur when the mycelial mass comprises a blue coloration. Obtaining the mycelial mass can comprise genetically modifying a fungal protoplast and culturing the genetically modified fungal protoplast to generate the population of fungal cells. Genetically modifying the fungal protoplast can comprise integrating an exogenous nucleic acid into the genome of the fungal protoplast. The exogenous nucleic acid can comprise a gene encoding a gene product that is involved in biosynthesis of the alkaloid, wherein the gene is selected from PsiM, PsiH, PsiH2, PsiK, PsiM, PsiR, or a variant thereof. The exogenous nucleic acid can comprise a sequence that is at least 95% identical to any one of SEQ ID NOS 1-16. Genetically modifying the fungal protoplast can comprise delivering an exogenous nucleic acid into the fugal protoplast by electroporation, microinjection, mechanical cell deformation, a lipid nanoparticle, a lentivirus, or *agrobacterium* mediated transformation. The genetic modification can be accomplished by an endonuclease system. The endonuclease system can comprise an endonuclease complexed with guide nucleic acid. The endonuclease can comprise a Cas endonuclease and the nucleic acid comprises a guide RNA. The guide RNA can comprise a targeting sequence that has a 95% identity to any one of SEQ ID NOS: 29-64. The population of fungal cells can comprise an increased expression of L-tryptophan decarboxylase as compared to a comparable wild-type population of fungal cells.

In some embodiments, the exogenous nucleic acid encodes a heterologous protein. In some embodiments, the nucleic acid encodes a PsiM gene from *P. azurescence*. In some embodiments, the PsiM gene is codon optimized for expression in *P. cubensis*. In some embodiments, the codon optimized PsiM is driven by a GPD promoter. In some embodiments, the exogenous nucleic acid comprises a sequence that is at least 50%, at least 55%, at least 60%, at least 65%, at least 70%, at least 75%, at least 80%, at least 85%, at least 90%, at least 95%, or at least 100% identical to SEQ ID NO: 502.

In some embodiments, the exogenous nucleic acid encodes a heterologous protein. In some embodiments, the heterologous protein comprises TrpM from *P. serbica*. In some embodiments, the TrpM gene is codon optimized for expression in *P. cubensis*. In some embodiments, the TrpM gene is driven by a GPD promoter. In some embodiments, the exogenous nucleic acid comprises a sequence that is at least 50%, at least 55%, at least 60%, at least 65%, at least 70%, at least 75%, at least 80%, at least 85%, at least 90%, at least 95%, or at least 100% identical to SEQ ID NO: 503.

In some embodiments, the exogenous nucleic acid encodes a strictosidine synthase gene (STST) from *Catharanthus roseus*. In some embodiments, the STST gene is codon optimized for expression in *P. cubensis*. In some embodiments, the STST gene is driven by a GPD promoter. In some embodiments, the exogenous nucleic acid comprises a sequence that is at least 50%, at least 55%, at least 60%, at least 65%, at least 70%, at least 75%, at least 80%, at least 85%, at least 90%, at least 95%, or at least 100% identical to SEQ ID NO: 504.

In some embodiments, the exogenous nucleic acid encodes an indolethylamine N-methyltransferase (INMT) gene from *Homo sapiens*. In some embodiments, the INMT gene is codon optimized for expression in *P. cubensis*. In some embodiments, the INMT gene is driven by a GPD promoter. In some embodiments, the exogenous nucleic acid comprises a sequence that is at least 50%, at least 55%, at least 60%, at least 65%, at least 70%, at least 75%, at least 80%, at least 85%, at least 90%, at least 95%, or at least 100% identical to SEQ ID NO: 505.

In some embodiments, the exogenous nucleic acid encodes McbB from marine actinomycete *M. thermotolerans*. In some embodiments, the MccB gene is codon optimized for expression in *P. cubensis*. In some embodiments, the MccB gene is driven by a GPD promoter. In some embodiments, the exogenous nucleic acid comprises a sequence that is at least 50%, at least 55%, at least 60%, at least 65%, at least 70%, at least 75%, at least 80%, at least 85%, at least 90%, at least 95%, or at least 100% identical to SEQ ID NO: 506.

In some embodiments, this disclosure provides tools and reagents for making a genetic modification. In some embodiments, this disclosure provides vectors for introducing guide nucleic acids into an organism. In some embodiments, the vector comprises a sequence that is at least 50%, at least 55%, at least 60%, at least 65%, at least 70%, at least 75%, at least 80%, at least 85%, at least 90%, at least 95%, or at least 100% identical to SEQ ID NO: 507.

In some embodiments, the vector comprises a sequence that is at least 50%, at least 55%, at least 60%, at least 65%, at least 70%, at least 75%, at least 80%, at least 85%, at least 90%, at least 95%, or at least 100% identical to SEQ ID NO: 508.

In some embodiments, the vector comprises a sequence that is at least 50%, at least 55%, at least 60%, at least 65%, at least 70%, at least 75%, at least 80%, at least 85%, at least 90%, at least 95%, or at least 100% identical to SEQ ID NO: 509.

In some embodiments, the vector comprises a sequence that is at least 50%, at least 55%, at least 60%, at least 65%, at least 70%, at least 75%, at least 80%, at least 85%, at least 90%, at least 95%, or at least 100% identical to SEQ ID NO: 510.

In some embodiments, the vector comprises a sequence that is at least 5000, at least 55%, at least 600%, at least 650%, at least 700%, at least 750%, at least 800%, at least 850%, at least 900%, at least 9500 or at least 10000 identical to SEQ ID NO: 511.

TABLE 23

Exemplary Plasmid sequences

| SEQ ID NO | Name | Sequence |
|---|---|---|
| 500 | GPD_intron_Pc_PsiM_Pc_codon_optimised | GAGGTCCGCAAGTAGATTGAAAGTTCAGTACGTTTTTAAC AATAGAGCATTTTCGAGGCTTGCGTCATTCTGTGTCAGGC TAGCAGTTTATAAGCGTTGAGGATCTAGAGCTGCTGTTCC CGCGTCTCGAATGTTCTCGGTGTTTAGGGGTTAGCAATCT GATATGATAATAATTTGTGATGACATCGATAGTACAAAAA CCCCAATTCCGGTCACATCCACCATCTCCGTTTTCTCCCAT CTACACACAACAAGCTCATCGCCGTTTGTCTCTCGCTTGCA TACCACCCAGCAGCTCACTGATGTCGACTTGTAGATGCAT ATCAGAAACCCATATAGAACACCAATCGATTATCAAGCAC TCTCTGAAGCATTCCCACCACTCAAACCATTCGTCTCTGTC AACGCAGATGGAACATCTTCTGTCGATCTCACAATCCCAG AAGCACAAAGAGCATTCACAGCAGCACTCCTCCATAGAG ATTTCGGACTCACAATGACAATC TABLE 23-continued Exemplary Plasmid sequences

| SEQ ID NO | Name | Sequence |
|---|---|---|
| 501 | GPD_intron_ PcAAAD_ Pc_ optimised: | GAGGTCCGCAAGTAGATTGAAAGTTCAGTACGTTTTTAAC AATAGAGCATTTTCGAGGCTTGCGTCATTCTGTGTCAGGC TAGCAGTTTATAAGCGTTGAGGATCTAGAGCTGCTGTTCC CGCGTCTCGAATGTTCTCGGTGTTTAGGGGTTAGCAATCT GATATGATAATAATTTGTGATGACATCGATAGTACAAAAA CCCCAATTCCGGTCACATCCACCATCTCCGTTTTCTCCCAT CTACACACAACAAGCTCATCGCCGTTTGTCTCTCGCTTGCA TACCACCCAGCAGCTCACTGATGTCGACTTGTAGATGCCA TCTTCTCATCCACATATCACACATAGATATAGAGTCCCATC TTCTGATGATCATGAAAGAATCTCTGCACTCTTCCTCGGAC CAAAAGCAGAAAACGCAGCATTCCTCCAACAATGGCTCA CAACAGTCGTCGCACAACAAAAAGCAGCAAGAGATGCAT ATTTCCCAGATGATAACGCATTCATCACAACAGATATGCA AACATCTCCAGCATTCGCACAAACAACAAAAGTCATCGCA TCTAACCTCACAGAACTCCTCACAGCACTCGGAGAAAGAT CTATCCCATTCTTCTCTCCAAGATATTCTGGACATATGTCT GTCGATCAATCTCTCCCAGCAATCCTCGGATTCCTCTCTAC AACATTCTATAACCCAAACAACGTCGCATTCGAAGCATCT CCATTCACAACACTCATCGAAGAAGAAGTCGGACTCCAAC TCTCTGAAATGCTCGGATATAACAGACTCAACAACACAGA AAAACCACTCGCATGGGACATATCGCATCTGGAGGAAC AGTCGCAAACCTCGAAGCAATGTGGGCAGCAAGAAACCT CAAATTCTATCCACTCTCTCTCAGAGATGCATCTGCAGAA GGAGCAGAAATGGAATTCATCAGAGATACATTCTCTGTCA AAACATGCGTCGGAGATAAAAAACTCCTCAAAGATTGCTC TCCATGGGAACTCCTCAACCTCCATGTCTCTACAATCCTCG ATATGCCAGATAGACTCCATGATGAATATAACATCTCTCC ACAATTCCTCGAAAAAGTCATGAGAAAATATATCATCCAA TCTACAAACAAAGATACACTCATGCAAAGATGGGGACTC ACACAACAACCAGTCGTCCTCTCTCCATCTACAAACCATT ATTCTTGGCCAAAAGCAGCAGCAGTCCTCGGAATCGGATC TGATAACCTCAGAAACGTCCCAGTCGATATCCAAGCACAT ATGGATATCAACGAACTCGATAGAATGCTCAAAATCTGCC TCGATGAAGAAACACCAGTCTATCAAGTCGTCGCAGTCAT CGGAACAACAGAAGAAGGAGGAGTCGATAGAATCACAGA AATCCTCAAACTCAGACAAAAATATGAAGCACTCGGACTC TCTTTTCGCAATCCATGCAGATGCAGCATGGGGAGGATATT TCGCAACAATGCTCCCAAAAGATACACTCGGAAGAAACA GAACAAGACTCCCAAAAGAAGATACAACATCTGGATTCG TCCCACATGTCGGACTCAGAGAAGAATCTGCACTCCAACT CTCTCATATCAAATATGCAGATTCTATCACAATCGATCCA CATAAAGCAGGATATGTCCCATATCCAGCAGGAGCACTCT GCTATAGAGATGGAAGAATGAGATATCTCCTCACATGGTC TGCACCATATCTCGCACAAGGAAACGAAGGACAATCTATC GGAATCTATGGAATCGAAGGATCTAAACCAGGAGCAGCA GCATCTGCAGTCTTCATGGCACATGAAACAATCGGACTCA CACCATCTGGATATGGAAACCTCCTCGGACAAGCAATGTT CACATGCAGAAGATATGCAGCACATTGGTCTGCAATGTCT ACAGATACAACATCTTTCACAGTCACACCATTCAACCCAA TCCCAGCAGATATCGATCCAAACGCAGATCCAGCAAAAGT CGAAGAACAAAAACAATTCATCAGAGATAGAATCCTCTTC AAATCTAACGAAGAAATCTATAACGATTCTGAAGCAATGG AACTCCTCCATCAACTCGGATCTGATCTCAACATCAACGT CTTCGCATGCAACTTCAGAGATAGAGATAACACCTCAAC ACAGATGTCGAAGAAGCAAACTGGCTCAACAACAGAATC TTCCAAAGATTCTCTGTCACATCTGCAGAAGAAAACCCAC TCGAAACACCATTCTTCCTCTCTTCTACAACACTCAAACAA TCTGAATATGGAGTCTGCGCAACAGAAGTCAAAAGAAGA ATGGGACTCGTCGGAGATCAAGATGTCATCGTCCTCAGAA ACGTCGTCATGTCTCCATTCACAACAACAAACGATTTCGT CGGAACACTCGCAAACACATTCCAAAAAATCGTCGAAGA AGAAGTCGAATATGCAAGAATCAGAAACGATATGAAACC ATCTATCCATACATTCCTCCTCCATGGATCTGGAGAACAA TATTATCTCGTCCATACACCAACAATCCATATGGCATCTG GAAGAAGACAAATCATCCTCTCTGTCAACGTCGAAGGACA AGTCAGACAAGCAATCCATGCACATGAAAGAGTCGAAGC AGTCATCGTCCATAACACAGTCCCACTCAGACTCGATGAA ATCGTCGATGGAGGATCTTTCGATGGAATCCTCACAATCG GAAAAAGAAAAACATCTTTCAAAGTCAAAATCTAACAT CAAAGTCGTCAAAAAAGATCTCTCATGACAGAAGATCTC GAATCTGCATATCCATCTCTCATGCCATTCTATTTCTATGG AACACAAGGACATGCACATCTCGATCATGTCATCACAGTC GTCCCAAACATCCATCTCTCTGCAGGAGAAATCCAATATA AATTCGATGATGAAGTCTCTTCTGAAGATCTCGCAAAAGG |

TABLE 23-continued

Exemplary Plasmid sequences

| SEQ ID NO | Name | Sequence |
|---|---|---|
| | | ACTCATCGTCGTCGCAGAAAACGTCCATGAAGCATCTATG<br>CAACCATTCCCACTCATGAAAGATTTCAAAATCACAAACC<br>AATTCTTCTTCTCTTCTGGACAAATCCTCAGAGTCAAAGTC<br>TATAGAGATCCATATCCAGCATCTACAATGGATCCAATCC<br>CACTCCATGATATCAAAAACCAACCAGTCGTCACACAAGG<br>AACAATCACACTCGTCGGAAACATCTATGTCGATTCTGAT<br>GCACTCAACGTCGCATCTGAACCAACAGCAGATGAAGAT<br>GCAGCACATGTCCCACATGCAAGAAACATGTATGGAGAA<br>ATGACAGCAGGAACAATCAAAGGATGGCAAAACGCAGTC<br>AGACATTTCCATAACAAACTCGAAACAGTCGCACCAACAA<br>AATAG |
| 502 | GPD_intron_<br>PsiM_<br>Azu_Pc_<br>optimised: | GAGGTCCGCAAGTAGATTGAAAGTTCAGTACGTTTTTAAC<br>AATAGAGCATTTTCGAGGCTTGCGTCATTCTGTGTCAGGC<br>TAGCAGTTTATAAGCGTTGAGGATCTAGAGCTGCTGTTCC<br>CGCGTCTCGAATGTTCTCGGTGTTTAGGGGTTAGCAATCT<br>GATATGATAATAATTTGTGATGACATCGATAGTACAAAAA<br>CCCCAATTCCGGTCACATCCACCATCTCCGTTTTCTCCCAT<br>CTACACACAACAAGCTCATCGCCGTTTGTCTCTCGCTTGCA<br>TACCCACCCAGCAGCTCACTGATGTCGACTTGTAGATGCAT<br>ATCAGAAACCCATATAGAACACCAATCGATTATCAAGCAC<br>TCGTCGAAGCATTCCCACCACTCAAACCATATGTCACAGT<br>CAACCAAGATAACACAACATCTATCGATCTCACAGTCCCA<br>GAAGTCCAAAGACTCTATACAGCAGCACTCCTCCATAGAG<br>ATTTCGGACTCGTCATCGATCTCCCAGAAGATAGACTCTG<br>CCCAACACTCCTCACAAGAACACCATCTCTCAACTATGTC<br>CTCTGGGTCGAAGATATCCTCAAAGTCACAAACACAGCAC<br>TCGGACTCTCTGAAGATAGACCAGTCAAAGGAATCGATAT<br>CGGAACAGGAGCAGCAGCAATCTATCCAATGCTCGCATGC<br>GCAAGATTCAAAACATGGTCTATGATCGGAACAGAAATC<br>GATAGAAAATGCATCGATACAGCAAGAGTCAACGTCCTC<br>ACAAACAACCTCCAAGATAGACTCTCTATCATCGAAACAT<br>CTATCGATGGACCAATCCTCGTCCCAATCTTCGAAGCAAC<br>AACAGATTATGAATATGATTTCACAATGTGCAACCCACCA<br>TTCTATGATGGAGCAGCAGATATGCAAACATCTGATGCAG<br>CAAAAGGATTCGGATTCGGAGTCAACGCACCACATTCTGG<br>AACAGTCATCGAAATGTCTACAGAAGGAGGAGAATCTGC<br>ATTCGTCGCACAAATGGTCAGAGAATCTCTCGATCATAGA<br>ACAAGATGCAGATGGTTCACATCTAACCTCGGAAAACTCA<br>AATCTCTCCATGAAATCGTCGGACTCCTCAGAGAACATCA<br>AATCTCTAACTATGCAATCAACGAATATGTCCAAGGAACA<br>ACAAGAAGATATGCAATCGCATGGTCTTTCACAAACATCA<br>GACTCCCAGAAGATCTCACAAGACCATCTAACCCAGAACT<br>CTCTTCTCTCTTCTGA |
| 503 | GPD_intron_<br>PsTrpM_<br>Pc_<br>optimised: | GAGGTCCGCAAGTAGATTGAAAGTTCAGTACGTTTTTAAC<br>AATAGAGCATTTTCGAGGCTTGCGTCATTCTGTGTCAGGC<br>TAGCAGTTTATAAGCGTTGAGGATCTAGAGCTGCTGTTCC<br>CGCGTCTCGAATGTTCTCGGTGTTTAGGGGTTAGCAATCT<br>GATATGATAATAATTTGTGATGACATCGATAGTACAAAAA<br>CCCCAATTCCGGTCACATCCACCATCTCCGTTTTCTCCCAT<br>CTACACACAACAAGCTCATCGCCGTTTGTCTCTCGCTTGCA<br>TACCCACCCAGCAGCTCACTGATGTCGACTTGTAGATGCCA<br>AGAATCCAAGTCCTCGATATCAGAGGATCTAAAGAATCTG<br>TCGGATCTACACCACATCTCAGAGCAGCAATCCTCGAAGG<br>ACTCCTCAAACCACCAGGATCTAGAACACTCCCATCTGAA<br>ACACTCTATGATGAAGTCGGACTCAAAATGTATAACGATG<br>GAATGAAAGCATGGGCAGAATGGTATTATCCAGTCGAAG<br>CAGAAAGACAAATCCTCGAAAGATATGGAAGAGATATCG<br>CAAAACTCTTCACAACATCTGCAAAAGGAAAGCAGTCCT<br>CATCGAACTCGGAGCAGGATCTCTCGATAAAACATCTCAA<br>GTCCTCCTCTCTGCAGCAGAAATCACAAGAACAACAGGAC<br>CAATGAACAACATCGCATATTATGCACTCGATCTCGAAAG<br>AGGAGAACTCGAAAGAACAATCGGAAGACTCCAAGAAGT<br>CATCGGAGATCAAATCGCAGGAAAAATCTCTACAGCAGG<br>AATGTGGGAACATATGATGATGGAATCAGAGTCATCGA<br>AAAAAACGAACTCGAACTCGAACCAGATATCCCAGTCCAT<br>ATCCTCTTCCTCGGAGGAACAATCGGAACTTCTCTAAAC<br>AAGATGGAGATGTCGCATTCCTCAAATCTCTCCCACTCGA<br>TCATAAAAGAGGAGATACACTCCTCGTCGGAATGGATAG<br>ACATAAATCTGCAGATGCAATCGAAAGATCTTATGGATTC<br>GCAGCAGCAAAAGATTGGATCATGAACGGACTCAAAGTC<br>TCTGGAAGAGTCCTCACAGGAGATGAAGGACTCTTCGAAA<br>TCGGAAACTGGGAAAGATATGCAAAATATAACGAAGAAC<br>TCGGAAGATATGAAGCAGGATATAAATCTCAAAAGAAC |

TABLE 23-continued

Exemplary Plasmid sequences

| SEQ ID NO | Name | Sequence |
|---|---|---|
| | | ATGCACTCAAAATCTCTGAAGGAGTCGATATCACATTCCT CAAAGATGAAGTCGTCCTCGTCATGTTCTCTAACAAATAT ACAGATGCAGAAATGGATTCTGTCGTCGATTCTGCAGGAC TCGTCAAAAACGGATCTTGGATGGATGAAAAAGCACAAT ATTGCCTCCTCTCTCTCAGAGCAAACAACGGACCAGTCTG A |
| 504 | GPD_intron_ STST_Pc_ optimised | GAGGTCCGCAAGTAGATTGAAAGTTCAGTACGTTTTTAAC AATAGAGCATTTTCGAGGCTTGCGTCATTCTGTGTCAGGC TAGCAGTTTATAAGCGTTGAGGATCTAGAGCTGCTGTTCC CGCGTCTCGAATGTTCTCGGTGTTTAGGGGTTAGCAATCT GATATGATAATAATTTGTGATGACATCGATAGTACAAAAA CCCCAATTCCGGTCACATCCACCATCTCCGTTTTCTCCCAT CTACACACAACAAGCTCATCGCCGTTTGTCTCTCGCTTGCA TACCACCCAGCAGCTCACTGATGTCGACTTGTAGATGGCA AACTTCTCTGAATCTAAATCTATGATGGCAGTCTTCTTCAT GTTCTTCCTCCTCCTCCTCTCTTCTTCTTCTTCTTCTTCTTCT TCTTCTCCAATCCTCAAAAAAATCTTCATCGAATCTCCATC TTATGCACCAAACGCATTCACATTCGATTCTACAGATAAA GGATTCTATACATCTGTCCAAGATGGAAGAGTCATCAAAT ATGAAGGACCAAACTCTGGATTCACAGATTTCGCATATGC ATCTCCATTCTGGAACAAAGCATTCTGCGAAAACTCTACA GATCCAGAAAAAGACCACTCTGCGGAAGAACATATGAT ATCTCTTATGATTATAAAAACTCTCAAATGTATATCGTCGA TGGACATTATCATCTCTGCGTCGTCGGAAAAGAAGGAGGA TATGCAACACAACTCGCAACATCTGTCCAAGGAGTCCCAT TCAAATGGCTCTATGCAGTCACAGTCGATCAAAGAACAGG AATCGTCTATTTCACAGATGTCTCTTCTATCCATGATGATT CTCCAGAAGGAGTCGAAGAAATCATGAACACATCTGATA GAACAGGAAGACTCATGAAATATGATCCATCTACAAAAG AAACAACACTCCTCCTCAAAGAACTCCATGTCCCAGGAGG AGCAGAAATCTCTGCAGATGGATCTTTCGTCGTCGTCGCA GAATTCCTCTCTAACAGAATCGTCAAATATTGGCTCGAAG GACCAAAAAAAGGATCTGCAGAATTCCTCGTCACAATCCC AAACCCAGGAAACATCAAAAGAAACTCTGATGGACATTT CTGGGTCTCTTCTTCTGAAGAACTCGATGGAGGACAACAT GGAAGAGTCGTCTCTAGAGGAATCAAATTCGATGGATTCG GAAACATCCTCCAAGTCATCCCACTCCCACCACCATATGA AGGAGAACATTTCGAACAAATCCAAGAACATGATGGACT CCTCTATATCGGATCTCTCTTCCATTCTTCTGTCGGAATCC TCGTCTATGATGATCATGATAACAAAGGAAACTCTTATGT CTCTTCTTGA |
| 505 | GPD_intron_ HsINMT_ Pc_ optimised: | GAGGTCCGCAAGTAGATTGAAAGTTCAGTACGTTTTTAAC AATAGAGCATTTTCGAGGCTTGCGTCATTCTGTGTCAGGC TAGCAGTTTATAAGCGTTGAGGATCTAGAGCTGCTGTTCC CGCGTCTCGAATGTTCTCGGTGTTTAGGGGTTAGCAATCT GATATGATAATAATTTGTGATGACATCGATAGTACAAAAA CCCCAATTCCGGTCACATCCACCATCTCCGTTTTCTCCCAT CTACACACAACAAGCTCATCGCCGTTTGTCTCTCGCTTGCA TACCACCCAGCAGCTCACTGATGTCGACTTGTAGATGAAA GGAGGATTCACAGGAGGAGATGAATATCAAAAACATTTC CTCCCAAGAGATTATCTCGCAACATATTATTCTTTCGATGG ATCTCCATCTCCAGAAGCAGAAATGCTCAAATTCAACCTC GAATGCCTCCATAAAACATTCGGACCAGGAGGACTCCAA GGAGATACACTCATCGATATCGGATCTGGACCAACAATCT ATCAAGTCCTCGCAGCATTCGATTCTTTCCAAGATATCAC ACTCTCTGATTTCACAGATAGAAACAGAGAAGAACTCGAA AAATGGCTCAAAAAAGAACCAGGAGCATATGATTGGACA CCAGCAGTCAAATTCGCATGCGAACTCGAAGGAAACTCTG GAAGATGGGAAGAAAAGAAGAAAAACTCAGAGCAGCA GTCAAAAGAGTCCTCAAATGCGATGTCCATCTCGGAAACC CACTCGCACCAGCAGTCCTCCCACTCGCAGATTGCGTCCT CACACTCCTCGCAATGGAATGCGCATGCTGCTCTCTCGAT GCATATAGAGCAGCACTCTGCAACCTCGCATCTCTCCTCA AACCAGGAGGACATCCGTCACAACAGTCACACTCCAGACT CCCATCTTATATGGTCGGAAAAAGAGAATTCTCTTGCGTC GCACTCGAAAAGAAGAGTCGAACAAGCAGTCCTCGAT GCAGGATTCGATATCGAACAACTCCTCCATTCTCCACAAT CTTATTCTGTCACAAACGCAGCAAACAACGGAGTCTGCTT CATCGTCGCAAGAAAAAAAACCAGGACCATGA |
| 506 | GPD_intron_ MccB_Pc_ optimised | GAGGTCCGCAAGTAGATTGAAAGTTCAGTACGTTTTTAAC AATAGAGCATTTTCGAGGCTTGCGTCATTCTGTGTCAGGC TAGCAGTTTATAAGCGTTGAGGATCTAGAGCTGCTGTTCC |

TABLE 23-continued

Exemplary Plasmid sequences

| SEQ ID NO | Name | Sequence |
|---|---|---|
| | | CGCGTCTCGAATGTTCTCGGTGTTTAGGGGTTAGCAATCT
GATATGATAATAATTTGTGATGACATCGATAGTACAAAAA
CCCCAATTCCGGTCACATCCACCATCTCCGTTTTCTCCCAT
CTACACACAACAAGCTCATCGCCGTTTGTCTCTCGCTTGCA
TACCACCCAGCAGCTCACTGATGTCGACTTGTAGATGAGA
CAAATCGAAATCGAATGGGTCCAACCAGGAATCACAGTC
ACAGCAGATCTCTCTTGGGAAAGAAACCCAGAACTCGCA
GAACTCCTCTGGACAGGACTCCTCCCATATAACTCTCTCC
AAAACCATGCACTCGTCTCTGGAAACCATCTCTATCATCT
CATCGCAGATCCAAGACTCGTCTATACAGAAGCAAGATAT
AAAGAAGATAGAACAAAATCTCCAGATGGAACAGTCTTC
CTCTCTCAACTCCAACATCTCGCAGTCAAATATGGACCAC
TCACAGAATATCTCCCAGCAGCACCAGTCGGATCTGTCGT
CCCCAGAAGATATCGATGCACTCAGAGAAGCAGGAAGAGC
ATGCTGGAAAGCAGCATGGGAAACAAAACAACCAATCGA
AGTCAGAGTCAGAAGAAAAGGAGAAGCAGTCACAGATTT
CGCACTCCCAAGAACACCACCAGTCGATCATCCAGGAGTC
CAAAAACTCGTCGAAGAAATCCAAGATGAAACAGAAAGA
GTCTGGATCACACCACCAGCAGAAATCGTCGATATGCATC
AAGGAAGAATCGCATCTAGAGCAGGATCTTATGATCAATA
TTTCTCTACACTCGTCTTCCTCAACGGAGAAGTCAGACCA
CTCGGATATTGCGCACTCAACGGACTCCTCAAAATCTGCA
GAACAACAGATCTCACACTCAACGATCTCAAAAGAATCAC
ACCAACATTCATCAAAACACCAGCAGAATTCCTCGGATAT
ACAGGACTCGATACACTCTGGAGATTCACACAACAAGTCC
TCACACTCCTCCCAGATGTCGAAACAAGAGAACAATATTT
CGCACTCGTCAACGCACTCGCACTCTATGCAAACATGCTC
AACACATGGAACCTCCATTTCTTCCCATGGCAACATGGAA
CAGATTATAGATATCTCGATGCATGA |
| 507 | pMGB-Ribo_empty Annotated in pUC57: | tcgcgcgtttcggtgatgacggtgaaaacctctgacacatgcagctcccggagacggtcacagc
ttgtctgtaagcggatgccgggagcagacaagcccgtcagggcgcgtcagcgggtgttggcg
ggtgtcggggctggcttaactatgcggcatcagagcagattgtactgagagtgcaccatatgcg
gtgtgaaataccgcacagatgcgtaaggagaaaataccgcatcaggcgccattcgccattcagg
ctgcgcaactgttgggaagggcgatcggtgcgggcctcttcgctattacgccagctggcgaaag
ggggatgtgctgcaaggcgattaagttgggtaacgccagggttttcccagtcacgacgttgtaaa
acgacggccagtgaattcgagctcggtacctcgcgaatgcatctagataacaggtctcaaacaG
ACGCTGTGGATCAAGCAACGCCACTCGCTCGCTCCATCGC
AGGCTGGTCGCAGACAAATTAAAAGGCGGCAAACTCGTA
CAGCCGCGGGGTTGTCCGCTGCAAAGTACAGAGTGATAA
AAGCCGCCATGCGACCATCAACGCGTTGATGCCCAGCTTT
TTCGATCCGAGAATCCACCGTAGAGGCGATAGCAAGTAA
AGAAAAGCTAAACAAAAAAAAATTTCTGCCCCTAAGCCA
TGAAAACGAGATGGGGTGGAGCAGAACCAAGGAAAGAGT
CGCGCTGGGCTGCCGTTCCGGAAGGTGTTGTAAAGGCTCG
ACGCCCAAGGTGGGAGTCTAGGAGAAGAATTTGCATCGG
GAGTGGGGGGGTTACCCCTCCATATCCAATGACAGATAT
CTACCAGCCAAGGGTTTGAGCCCGCCCGCTTAGTCGTCGT
CCTCGCTTGCCCCTCCATAAAGGATTTCCCCTCCCCCTCC
CACAAAATTTTCTTTCCCTTCCTCTCCTTGTCCGCTTCAGT
ACGTATATCTTCCCTTCCCTCGCTTCTCTCCTCCATCCTTCT
TTCATCCATCTCCTGCTAACTTCTCTGCTCAGCACCTCTAC
GCATTACTAGCCGTAGTATCTGAGCACTTCTCCCTTTTATA
TTCCACAAAACATAACACAACCTTCACCgggtcttcgccggatccagt
gctaacatggtctagaaggaggtcagctatgcagtttaaggtttacacctataaaagagagagc
gttatcgtctgtttgtggatgtacagagtgatattattgacacgcccgggcgacggatggtgatccc
cctggccagtgcacgtctgctgtcagataaagtctcccgtgaactttacccagtggtgcatatcgg
ggatgaaagctggcgcatgatgaccaccgatatggccagtgtgccagtctccgttatcggggaa
gaagtggctgatctcagccaccgcgaaaatgacatcaaaaacgccattaacctgatgttctgggg
aatataactgcagaggaggtaatcaagaagacctGTTTTAGAGCTAGAAATAG
CAAGTTAAAATAAGGCTAGTCCGTTATCAACTTGAAAAAG
TGGCACCGAGTCGGTGCTTTTGGCCGGCATGGTCCCAGCC
TCCTCGCTGGCGCCGGCTGGGCAACATGCTTCGGCATGGC
GAATGGGACTGAGAAACAGGTCGGAAGCCAATGGCCAGG
AGCTCCTTGTAAAAAAATACTCCTTGGTCTATTAAGTTGCC
CATTCTTTTAGCAGGAGTGTGCAGACTATGTCCGTATCCAC
ATGCCGCAACTGCAGATTCATAGGAGCTGTTGGGGATATT
GGCATAGGATCCCATTGTTACGTACATTTAATGACAAAT
ACACGATCAATTTCACCACTATTGTTCACTTCTACTGGTAG
CTTAGACGTACTATTTCTCGTGGAATAGCCAGTACTTGCTC
TTATATTGGCCGTCGCGAATTTCGGCGTCGACAACGAGCT
ACCACATTTGTTCATGCCAGGCAatgccacaacactggtggtaccggcttg
agacctgttatcggatcccgggcccgtcgactgcagaggcctgcatgcaagcttggcgtaatcat
ggtcatagctgtttcctgtgtgaaattgttatccgctcacaattccacacaacatacgagccggaag
cataaagtgtaaagcctggggtgcctaatgagtgagctaactcacattaattgcgttgcgctcact |

TABLE 23-continued

Exemplary Plasmid sequences

| SEQ ID NO | Name | Sequence |
|---|---|---|
| | | gcccgcttttccagtcgggaaacctgtcgtgccagctgcattaatgaatcggccaacgcgcgggg agaggcggtttgcgtattgggcgctcttccgcttcctcgctcactgactcgctgcgctcggtcgttc ggctgcggcgagcggtatcagctcactcaaaggcggtaatacggttatccacagaatcagggg ataacgcaggaaagaacatgtgagcaaaaggccagcaaaaggccaggaaccgtaaaaaggc cgcgttgctggcgtttttccataggctccgcccccctgacgagcatcacaaaaatcgacgctcaa gtcagaggtggcgaaacccgacaggactataaagataccaggcgtttccccctggaagctccct cgtgcgctctcctgttccgaccctgccgcttaccggatacctgtccgcctttctcccttcgggaagc gtggcgctttctcatagctcacgctgtaggtatctcagttcggtgtaggtcgttcgctccaagctgg gctgtgtgcacgaaccccccgttcagcccgaccgctgcgccttatccggtaactatcgtcttgagt ccaacccggtaagacacgacttatcgccactggcagcagccactggtaacaggattagcagag cgaggtatgtaggcggtgctacagagttcttgaagtggtggcctaactacggctacactagaaga acagtatttggtatctgcgctctgctgaagccagttaccttcggaaaaagagttggtagctcttgat ccggcaaacaaaccaccgctggtagcggtggtttttttgtttgcaagcagcagattacgcgcaga aaaaaaggatctcaagaagatcctttgatcttttctacggggtctgacgctcagtggaacgaaaac tcacgttaagggattttggtcatgagattatcaaaaaggatcttcacctagatccttttaaattaaaaa tgaagttttaaatcaatctaaagtatatatgagtaaacttggtctgacagttaccaatgcttaatcagt gaggcacctatctcagcgatctgtctatttcgttcatccatagttgcctgactccccgtcgtgtagat aactacgatacgggagggcttaccatctggccccagtgctgcaatgataccgcgagatccacgc tcaccggctccagatttatcagcaataaaccagccagccggaagggccgagcgcagaagtggt cctgcaactttatccgcctccatccagtctattaattgttgccgggaagctagagtaagtagttcgc cagttaatagtttgcgcaacgttgttgccattgctacaggcatcgtggtgtcacgctcgtcgtttggt atggcttcattcagctccggttcccaacgatcaaggcgagttacatgatccccatgttgtgcaaa aaagcggttagctccttcggtcctccgatcgttgtcagaagtaagttggccgcagtgttatcactca tggttatggcagcactgcataattctcttactgtcatgccatccgtaagatgcttttctgtgactggtg agtactcaaccaagtcattctgagaatagtgtatgcggcgaccgagttgctcttgcccggcgtcaa tacgggataataccgcgccacatagcagaactttaaaagtgctcatcattggaaaacgttcttcgg ggcgaaaactctcaaggatcttaccgctgttgagatccagttcgatgtaacccactcgtgcaccca actgatcttcagcatcttttactttcaccagcgtttctgggtgagcaaaaacaggaaggcaaaatgc cgcaaaaaagggaataagggcgacacggaaatgttgaatactcatactcttcctttttcaatattatt gaagcatttatcagggttattgtctcatgagcggatacatatttgaatgtatttagaaaaataaacaa ataggggttccgcgcacatttccccgaaaagtgccacctgacgtctaagaaaccattattatcatg acattaacctataaaaataggcgtatcacgaggccctttcgtc |
| 508 | pMGD-AMA1 Annotated in pUC57_AL corrected | tcgcgcgtttcggtgatgacggtgaaaacctctgacacatgcagctcccggagacggtcacagc ttgtctgtaagcggatgccgggagcagacaagcccgtcagggcgcgtcagcgggtgttggcg ggtgtcggggctggcttaactatgcggcatcagagcagattgtactgagagtgcaccatatgcg gtgtgaaataccgcacagatgcgtaaggagaaaataccgcatcaggcgccattcgccattcagg ctgcgcaactgttgggaagggcgatcggtgcgggcctcttcgctattacgccagctggcgaaag gggatgtgctgcaaggcgattaagttgggtaacgccagggttttcccagtcacgacgttgtaaa acgacggccagtgaattcgagctcggtacctcgcgaatgcatctagataacaggtctcatcaga gcttatttttttgtatactgttttgtgatagcacgaagttttttccacggtatcttgttaaaatatatatttgt ggcgggcttacctacatcaaattaataagagactaattataaactaaacacaagcaagctacttt agggtaaaagtttataaatgcttttgacgtataaacgttgcttgtatttattattacaattaaaggtgga tagaaaacctagagactagttagaaactaatctcaggtttgcgttaaactaaatcagagcccgaga ggttaacagaacctagaagggactagatatccgggtagggaaacaaaaaaaaaancaaga cagccacatattagggagactagttagaagctagttccaggactaggaaaataaaagacaatgat accacagtctagttgacaactagatagattctagattgaggccaaagtctctgagatccaggttagt tgcaactaatactagttagtatctagtctcctataactctgaagctagaataacttactactattatcct caccactgttcagctgcgcaaacggagtgattgcaaggtgttcagagactagttattgctagtca gtgactagcaataactaacaaggtattaacctaccagtctgccatcaccctgcacttcctcgggct cagcagccttttcctcctcattttcatgctcatttttccttgtttaagactgtgactagtcaaagactagtc cagaaccacaaaggagaaatgtcttaccactttcttcattgcttgtctcttttgcattatccatgtctgc aactagttagagtctagttagtgactagtccgacgaggacttgcttgtctccggattgttggaggaa ctctccagggcctcaagatccacaacagagccttctagaagactagtcaataactagttggtcttt gtctgagtctgacttacgaggttgcatactcgctcccctttgcctcgtcaatcgatgagaaaaagcg ccaaaactcgcaatatggctttgaaccacacggtgctgagactagttagaatctagtcccaaacta gcttggatagcttacctttgcctttgcgttgcgacaggtcttgcagggtatggttcctttctcacca gctgatttagctgccttgctaccctcacggcggatctgcataaagagtggctagaggttataaatta gcactgatcctaggtacggggctgaatgtaacttgccyttcctttctcatcgcgcggcaagacag gcttgctcaaattcctaccagtcacaggggtatgcacggcgtacggaccacttgaactagtcaca gattagttagcaactagtctgcattgaatggctgtacttacgggccctcgccattgtcctgatcattt ccagcttcaccctcgttgctgcaaagtagttgactagtcaaggactagttgaaatgggagaa gaaactcacgaattctcgacaccctagtattgtggtccttggacttggtgctgctatatattagctaa tacactagttagactcacagaaacttacgcagctcgcttgcgcttcttggtaggagtcggggttgg gagaacagtgcctcaaacaagccttcataccatgctacttgactagtcagggactagtcaccaa gtaatctagatataggcttgcctttggcctccatcagttccttcatagtgggaggtccattgtgcaatg taaactccatgccgtgggagttccttrtccttcaagtgcttgaccaatatgtttctgttggcagaggga acctgtcaactagttaataactagtcagaaactagtatatagcagtagactcactgtacgcttgaggc atcccttcactcggcagtagacttcatatggatggatatcaggcacgccattgtcgtcctgtggact agtcagtaactaggcttaaagctcagtcggcttactatctttgaaatccggcacgcagcttaagctc cccgtccttaactgcctcgagatagtgacagtactctgggacttcggagatcgttatcgcgaat gctcggcatactaatcgttgactagtcttggactagtcccgagcaaaaaggattggaggaggag gaggaaggtgagagtgagacaaagagcgaaataagagcttcaaaggctatctctaagcagtat gaaggttaagtatctagttcttgactagattttaaaagagatttcgactagttatgtacctggagtttgg atataggaatgtgttgtggtaacgaaatgtaagggggaggaaagaaaaagtcggtcaagaggta |

TABLE 23-continued

Exemplary Plasmid sequences

| SEQ ID NO | Name | Sequence |
|---|---|---|
| | | actctaagtcggccattccttttttgggaggcgctaaccataaacggcatggtcgacttagagttag
ctcagggaatttagggagttatctgcgaccaccgaggaacggcggaatgccaaagaatcccga
tggagctctagctggcggttgacaaccccacctttttggcgtttctgcggcgttgcaggcgggact
ggatacttcgtagaaccagaaaggcaaggcagaacgcgctcagcaagagtgttggaagtgata
gcatgatgtgccttgttaactaggtcaaaatctgcagtatgcttgatgttatccaaagtgtgagaga
ggaaggtccaaacatacacgattgggagagggcctaggtataagagttttttgagtagaacgcat
gtgagcccagccatctcgaggagattaaacacgggccggcatttgatggctatgttagtacccca
atggaaacggtgagagtccagtggtcgcagataactccctaaattccctgagctaactctaagtc
gaccatgccgtttatggttagcgcctcccaaaaaggaatggccgacttagagttacctcttgaccg
acttttttctttcctcccccttacatttcgttaccacaacacattcctatatccaaactccaggtacataa
ctagtcgaaatctcttttaaatctagtcaagaactagatacttaaccttcatactgcttagagatagcc
tttgaagctcttatttcgctcttttgtctcactctcaactcctcctcctcctccaatccttttttgctcggga
ctagtccaagactagtcaacgattagtatgccgagcattcgcgataacgatctccgaaagtcccc
agagtactgtcactatctcgaggcagttaaggacggggagcttacgctgccggatttcaagatag
taagccgacccgactagctttaagcctagttactgactagtccacaggacgacaatggcgtgcct
gatatccatccatatgaagtctactgccgagtgaaggggatgcctcaagcgtacagtgagtctactg
ctatactagtttctgactagttattaactagttgacaggttccctctgccaacagaaacatattggtca
agcacttgaaggayaagaactcccacggcatggagtttacattgcacaatggaccctcccactatg
aaggaactgatggaggccaaaggcaagtcctatctagattacttggtgactagtccctgactagtc
aagtagcatggtatgaaggcttgtttgaaggcactgttctcccaaccccgactcctaccaagaag
cgcaagcgagctgcgtaagtttctgtgagtctaactagtgtattagctaatatatagcagcaccaa
gtccaaggaccacaatactaagggtgtcgagaattcgtgagtttcttctcccatttcaactagtcctt
gactagtcactaactactttgcagcaacgagggtgaagctggaaatgatcaggacaatggcgag
ggcccgtaagtacagccattcaatgcagactagttgctaactaatctgtgactagttcaagtggtcc
gtacgccgtgcatacccctgtgactggtaggaatttgagcaagcctgtcttgccgcgcgatgaga
aaggaarggcaagttacattcagccccgtacctaggatcagtgctaatttataacctctagccact
ctttatgcagatccgccgtgagggtagcaaggcagctaaatcagctggtgagaaaggaaccata
ccctgcaagacctgtcgcaacgcaaagggcaaaggtaagctatccaagctagtttgggactaga
ttctaactagtctcagcaccgtgtggttcaaagccatattgcagttttggcgcttttttctcatcgattg
acgaggcaaagggagcgagtatgcaacctcgtaagtcagactcagacaaagaccaactagtta
ttgaccagtcttctagaaggctctgttgtggatcttgaggccctggagagttcctccaacaatccgg
agacaagcaagtcctcgtcggactagtcactaactagactctaactagttgcagacatggataatg
caaaagagacaagcaatgaagaaagtggtaagactttctcctttgtggttctggactagtctttga
ctagtcacagtcttaaacaaggaaaatgagcatgaaaatgaggaggaaaaggctgctgagccc
gaggaagtgcagggtgatggcagacatggtaggttaataccttgttagttattgctagtcactgact
agtcaataactagtctctgaacaccttgcaatcactccgtttgcgcagctgaacagtggtgaggat
aatagtagtaagttattctagcttcagagttataggagactagatactaactagtagttagttgcaacta
acctggatctcagagactttggcctcaatctagaatctatctagttgtcaactagactgtggtatcatt
gtcttttattttcctagtcctggaactagcttctaactagtctccctaatatgtggctgtcttgtttttttttt
tgtttccctacccggatatcagtcccttctaggttctgttaacctctcgggctctgatttagtttaac
gcaaacctgagattagtttctaactagtctctaggtttttctatccacctttaattgtaataataaataca
agcaacgtttatacgtcaaaagcatttataaactttttacccctaaagtagcttgcttgtgtgtttagtttat
aattagtctcttattaatttgatgtaggtaagcccgccacaaatatatatttttaacaagataccgtgg
aaaaacttcgtgctatcacaaaacagtatacaaaaaataagctctgctgagacctgttatcggatc
ccgggcccgtcgactgcagaggcctgcatgcaagctttggcgtaatcatggtcatagctgtttcct
gtgtgaaattgttatccgctcacaattccacacaacatacgagccggaagcataaagtgtaaagc
ctggggtgcctaatgagtgagctaactcacattaattgcgttgcgctcactgcccgctttccagtcg
ggaaacctgtcgtgccagctgcattaatgaatcggccaacgcgcggggagaggcggtttgcgt
attgggcgctcttccgcttcctcgctcactgactcgctgcgctcggtcgttcggctgcggcgagc
ggtatcagctcactcaaaggcggtaatacggttatccacagaatcaggggataacgcaggaaag
aacatgtgagcaaaaggccagcaaaaggccaggaaccgtaaaaaggccgcgttgctggcgttt
ttccataggctccgcccccctgacgagcatcacaaaaatcgacgctcaagtcagaggtggcgaa
acccgacaggactataaagataccaggcgtttccccctggaagctccctcgtgcgctctcctgttc
cgaccctgccgcttaccggatacctgtccgcctttctcccttcgggaagcgtggcgctttctcata
gctcacgctgtaggtatctcagttcggtgtaggtcgttcgctccaagctgggctgtgtgcacgaac
cccccgttcagcccgaccgctgcgccttatccggtaactatcgtcttgagtccaacccggtaaga
cacgacttatcgccactggcagcagccactggtaacaggattagcagagcgaggtatgtaggc
ggtgctacagagttcttgaagtggtggcctaactacggctacactagaagaacagtatttggtatct
gcgctctgctgaagccagttaccttcggaaaaagagttggtagctcttgatccggcaaacaaacc
accgctggtagcggtggtttttttgtttgcaagcagcagattacgcgcagaaaaaaaggatctcaa
gaagatcctttgatcttttctacggggtctgacgctcagtggaacgaaaactcacgttaagggattt
tggtcatgagattatcaaaaaggatcttcacctagatcctttttaaattaaaaatgaagttttaaatcaat
ctaaagtatatatgagtaaacttggtctgacagttaccaatgcttaatcagtgaggcacctatctcag
cgatctgtctatttcgttcatccatagttgcctgactccccgtcgtgtagataactacgatacgggag
ggcttaccatctggccccagtgctgcaatgataccgcgagatccacgctcaccggctccagattt
atcagcaataaaccagccagccggaagggccgagcgcagaagtggtcctgcaactttatccgc
ctccatccagtctattaattgttgccgggaagctagagtaagtagttcgccagttaatagtttgcgca
acgttgttgccattgctacaggcatcgtggtgtcacgctcgtcgtttggtatggcttcattcagctcc
ggttcccaacgatcaaggcgagttacatgatccccatgttgtgcaaaaaagcggttagctccttc
ggtcctccgatcgttgtcagaagtaagttggccgcagtgttatcactcatggttatggcagcactg
cataattctcttactgtcatgccatccgtaagatgcttttctgtgactggtgagtactcaaccaagtca
ttctgagaatagtgtatgcggcgaccgagttgctcttgcccggcgtcaatacgggataataccgc
gccacatagcagaactttaaaagtgctcatcattggaaaacgttcttcggggcgaaaactctcaag
gatcttaccgctgttgagatccagttcgatgtaacccactcgtgcacccaactgatcttcagcatctt
ttactttcaccagcgtttctgggtgagcaaaaacaggaaggcaaaatgccgcaaaaaagggaat |

TABLE 23-continued

Exemplary Plasmid sequences

| SEQ ID NO | Name | Sequence |
|---|---|---|
| | | aagggcgacacggaaatgttgaatactcatactcttcctttttcaatattattgaagcatttatcaggg ttattgtctcatgagcggatacatatttgaatgtatttagaaaaataaacaaatagggttccgcgca catttccccgaaaagtgccacctgacgtctaagaaaccattattatcatgacattaacctataaaaat aggcgtatcacgaggccctttcgtc |
| 509 | GPD-s-i-6 bp-PcyPsiH2 overexpression vector | GAGGTCCGCAAGTAGATTGAAAGTTCAGTACGTTTTTAAC AATAGAGCATTTTCGAGGCTTGCGTCATTCTGTGTCAGGC TAGCAGTTTATAAGCGTTGAGGATCTAGAGCTGCTGTTCC CGCGTCTCGAATGTTCTCGGTGTTTAGGGGTTAGCAATCT GATATGATAATAATTTGTGATGACATCGATAGTACAAAAA CCCCAATTCCGGTCACATCCACCATCTCCGTTTTCTCCCAT CTACACACAACAAGCTCATCGCCATGGTTTGTC TCTCGCTTGCATACCACCCAGCAGCTCACTGATGTCGACTT GTAGGTTAAAGCACCTCTCACCACCATGATCCCCATAGTA CTCTCGCTCCTCATAGCAGGATGCATATACTACATCAACG CTCGCAGGATAAAGCGTTCCCGCTTACCCCCTGGACCGCC TGGCATACCTATCCCATTCATTGGGAATATGTTTGATATGC CTTCAGAGTCTCCATGGTTGATCTTTTTACAATGGGGACA GGAATATCAAACCGACATCATCTACGTCGATGCTGGAGGA ACGGACATGATTATTCTGAACTCATTGGAGGCTATAACCG ACTTGTTGGAAAAGCGGGGGTCCCTGTACTCCGGTCGACT CGAGAGCACGATGGTGAACGAGCTCATGGGATGGGAGTT CGATTTTGGATTCATACCCTACGGCGAGAGATGGCGCGAA GAAAGGCGCATGTTCGCCAAGGAGTTCAGCGAGAAAAAT ATAAGGCAATTCCGCCACGCTCAAGTGAAGGCTGCCAATC AGCTTGTCCGGCAGCTGACAGACAAGCCAGATCGTTGGTC ACACCACATCCGGCATCAGATAGCGTCTATGGCTCTGGAT ATTGGCTATGGGATCGATCTGGCCGAGGATGATCCCTGGA TTGCAGCATCTGAGCTAGCAAACGAAGGGCTCGCTGTTGC ATCAGTGCCGGGCAGTTTCTGGGTCGACACATTCCCTTTCC TTAAATACCTTCCGTCCTGGCTTCCAGGTGCTGAATTCAAG CGCAATGCAAAGATGTGGAAGGAAGGCGCTGACCATATG GTGAATATGCCATatgaaacaatgaaaaaaCTGTCTGCTCAAGGTTT GACCCGACCCTCATACGCCTCGGCTCGCCTCCAGGCTATG GATCCTAATGGCGATCTCGAGCACCAGGAACGTGTGATCA AGAATACGGCCACACAAGTCAATGTCGGTGGCGGTGATA CGACTGTCGGTGCTGTGTCAGCATTTATTTTAGCTATGGTC AAATATCCCGAGGTTCAACGTAAAGTCCAAGCTGAGCTGG ATGAATTCACGAGTAAAGGCCGTATCCCAGATTACGACGA AGATAACGACTCCTTGCCGTATCTCAGCGCATGCTTTAAG GAACTCTTTCGATGGGGCCAGATTGCACCCCTTGCTATTG CTCATCGACTTATCAAGGATGATGTTTACCGCGAGTATAC TATACCTAAGAATGCTTTGGTCTTCGCTAATAATTGGTACG GACGGACTGTACTGAACGATCCCTCTGAGTATCCAAATCC CTCTGAGTTCCGTCCAGAACGATATCTCGGTCCTGACGGG AAGCCCGACGATACGGTTCGTGATCCCCGCAAAGCAGCAT TCGGGTATGGTCGTCGCGTTTGCCCTGGAATCCACCTTGCT CAGTCGACGGTATGGATTGCAGGGGTGGCTCTTGTGTCCG CGTTCAACATCGAACTGCCTGTTGATAAGGATGGGAAATG TATTGACATACCAGCGGCGTTTACAACAGGATTTTTCAGG TAA |
| 510 | GPD-s-i-6 bp PtPsiH2 overexpression vector | GAGGTCCGCAAGTAGATTGAAAGTTCAGTACGTTTTTAAC AATAGAGCATTTTCGAGGCTTGCGTCATTCTGTGTCAGGC TAGCAGTTTATAAGCGTTGAGGATCTAGAGCTGCTGTTCC CGCGTCTCGAATGTTCTCGGTGTTTAGGGGTTAGCAATCT GATATGATAATAATTTGTGATGACATCGATAGTACAAAAA CCCCAATTCCGGTCACATCCACCATCTCCGTTTTCTCCCAT CTACACACAACAAGCTCATCGCCATGGTTTGTCTCTCGCTT GCATACCACCCAGCAGCTCACTGATGTCGACTTGTAGGTT AAACAAAACGGCGCACTCACTGTATTTGTTGCATTTATTTC TGCAGCGTGCATATACTATGTGCACGCTCGTCGGGCTCGG CGAGCCTCGCTGCCACCAGGTCGCGCGGAATACCCCTGC CATTTGTGGGGAATGTATTCGATATGCCTTCGGAGTCTTCT TGGCTCACGTTCCTGGAATGGGAAAACAGTATCAATCTG ATTTTGATCTACTTAAACTCCGGGGAATAGAAATGGTCAT TCTGAACACGTTGGAAACAATGACCGATCTCTTGGAGAAG AGGGGATCTATATATTCAGGACGACTAGAAAGTACAATG GTCAATGAACTCATGGGTTGGAAATTCGATTTTGGATTCG TGACCTATGGCGAGCGCtggcgagaagaaagacgcATGTTTTCGAG GGAGTTCAACgagaaaaatatcaaacaaTTTCGTCATGCACAAGTCA AGGCCCTCAAAGAACTCGTTCGGAAACTTGACAAAGACCC AAGTCGATGGTACCAGCATCTTCGACACCAAATTGCATCT ATGGCCTTGGATATTGGCTATGAATTGATCTCGCAGAAA ACGACCCATGGATTGAAGAGACCATCCTCGCAAACGATGC |

TABLE 23-continued

Exemplary Plasmid sequences

| SEQ ID NO | Name | Sequence |
|---|---|---|
| | | TCTAGCCCTTGCATCTGTCCCTGGGTGCTATTGGGTTGACT
CGTTTCCCATTCTTCAATATGTTCCATCTTGGCTTCCCTTTG
CAGGATTCAAGCGCAAAGCAAAGGtgtggaagaaaaataccGAGT
ACATGGTCAACGTTCTATACGAGACCATGAAAAGACAGA
CAGTACAAGGGTTAACCCGTCCATCCTATGCTTCAGCACG
TTTACAGGCCATGGCTCCAGACATTAACCTTGAACATCAA
GAACGGGTAATTAAAAATTCAGCCTCACAGGTTATTGTTG
GCGGTGGCGATACTACCGTGTCTGCATTGGCAGCATTTAT
TCTAGCTATGGTCAAATATCCTAATGTCCAACGCAAGGTC
CAGGCGGAGCTCGACGCGATCGCGAGCCAAAACGAAATA
CCCGactttgacgaagaaaatggaaCGATGCCATACCTCACCGCATGT
CTCAAAGAAGTTTTCCGCTGGAACCAGATCGCGCCCCTTG
GTATCGCCCACCGGCTTGACAAGGACGATTCTTACCGTGG
CTACCTCATACCCAAGGGAACCTTGGTTTTTGCCAACATTT
GGGCTATCTTGAACGATCCATTGATGTATCCTAATCCTGG
CGAGTTTCAACCTGAGCGATATCTCGGACCTGACGGCAAG
CACGATCCCTCTGTGCGCGACCCACGTAAAATTGCCTTCG
GCTGGGGTCGACGCGCTTGTCCCGGCATATACTTGGCACA
ATCCACCGTATGGCACACAGCAACGAACCTCCTCTCTGCA
TTCAACATAGAGCCACCTCTTAACGAAGAGGGAAAGCCTA
TCAAAGTCGAGGCGGCTTTCACCACTGGATTTTTCAGGTA
TAGTCCCCGCAGTGATGCATGA |
| 511 | PcuPsiR overexpression vector | GAGGTCCGCAAGTAGATTGAAAGTTCAGTACGTTTTTAAC
AATAGAGCATTTTCGAGGCTTGCGTCATTCTGTGTCAGGC
TAGCAGTTTATAAGCGTTGAGGATCTAGAGCTGCTGTTCC
CGCGTCTCGAATGTTCTCGGTGTTTAGGGGTTAGCAATCT
GATATGATAATAATTTGTGATGACATCGATAGTACAAAAA
CCCCAATTCCGGTCACATCCACCATCTCCGTTTTCTCCCAT
CTACACACAACAAGCTCATCGCCATGGTTTGTCTCTCGCTT
GCATACCACCCAGCAGCTCACTGATGTCGACTTGTAGGTT
AAAGCACCCGCAACACCCGCAACTCACGATCCTGCCTTGT
CCCACGGAGCCCCTCCTGCTCCAGGTGCTCCAGCTCCTGC
AAATGCTCCTCCAAACGCCTCAGGAGACATTGCTGGAATG
CAGCTCAGCGGACTCGATCAGTCCCAGATCATGAACCTTC
TTCGTTCATTGCCTGGCATGTTCTCGGGCGGTAAAATACCC
GACCAAGGCCAAGGCAACAAAGAGGATGCTGCTCAAACG
CTGTCCAACCTTGCCCAAGCTCAACCGTATGGACAACAAT
TACCCCTTCACTACCAAGCTGGCGGCCCAGGAGGTCTGCC
AGGAATTAACGACCCAGGCCCGTCCACACATCCCCGCGGC
CCTCCCAACCTTGGCCAACTGAGTGCTGTGGCAATGCAAG
CCGCCCCCGCTCCAATTCAGCATCCAGACCAGCAAACGAA
CCGCAACGATGGCGAGCAGGCTGGCAATGCGAGTGCAAG
TACCTCCGGAAAGGATGGTGACAATGCAGAATTCGTTCCC
CCACCTGCTCCTGCTCCTACAACTGGTCGCCGTGGTGGAC
GCAGCGCCACCATGGGAAGTGACGAATGGAGCAGACAGA
GGAAGGATAATCATAAAGAGGTTGAGCGTCGACGCCGCG
GCAATATCAACGAGGGCATCAACGAGCTTGGCCGCATTGT
ACCCAGTGGGTCTGGCGAGAAGGCCAAAGGCGCCATCCTT
TCTCGAGCTGTGCAGTACATCCATCATTTGAAAGAGAACG
AAGCTCGCAATATCGAGAAGTGGACCCTTGAGAAGCTTCT
CATGGACCAGGCCATGGGTGACCTGCAGGCGCAACTCGA
AGAGGTCAAGCGTCTGTGGGAAGAAGAGCGTATGGCGCG
CACAAGACTCGAGGCCGAGCTCGAAGTGTTGAGAAATAT
GAACGGCGTGAATGCTGGCTCGGCCCCGGCCTCGAAAGAT
GAGAGTGCTGCAGGTACTAAGAGGAGGAGTACCGATGGA
GCAGAGGCCGCCACCGCCGCCACTGAAAGCAGCACCGCC
AATGCCGAGGGCGAACGCGACGGCAAGCGACAAAGAACC
GAGTGA |

In some embodiments, this disclosure provides reagents, such as plasmids, useful for introducing genetic modifications into an organism. In some embodiments, the plasmids are optimized for introducing a genetic modification into the genome of a fungal cell. In some embodiments, the plasmids encode a gene editing system. In some embodiments, the plasmids encode one or more guide polynucleotides separately, or in combination with a gene editing system. In some embodiments, the guide polynucleotide comprises a targeting sequence for binding to a psilocybin synthase gene to thereby introduce a genetic modification into the psilocybin synthase gene. In some embodiments, the psilocybin synthase gene comprises PsiP1. In some embodiments, the psilocybin synthase gene comprises TrpE. In some embodiments, the guide polynucleotide comprises a sequence for binding to a non-coding region in a psi locus.

For example, provided herein are plasmids comprising guide polynucleotides with targeting sequences for binding PsiP1 and PsiP2 in combination with a codon optimized Cas9 and hygromycin resistance gene. See SEQ ID NOS: 601-602. Provided herein are also plasmids comprising guide polynucleotides for binding TrpE and watermark (i.e., a non-coding region in Psi locus) sequences in combination with a codon optimized Cas9 and hygromycin resistance (see SEQ ID NO: 603). Provided herein are plasmids encoding guide polynucleotides comprising targeting sequences for watermark (i.e., a non-coding region in Psi locus) sequences in combination with a codon optimized Cas9 and hygromycin resistance (see SEQ ID NO: 604). Provided herein are also plasmids comprising guide polynucleotides with target sequences for TrpE in combination with a codon optimized Cas9 and hygromycin resistance (see SEQ ID NO: 605). Provided herein are also plasmids encoding guide polynucleotides comprising sequences for binding PsiR in combination with a codon optimized Cas9 and hygromycin resistance (See SEQ ID NO: 606). In some embodiments, the plasmid is at least 75%, 80%, 85%, 90%, 95%, 99%, or 100% identical to one of the plasmids listed in TABLE 24. In some embodiments, the plasmid comprises a sequence selected from the group the consisting of any one of SEQ ID NOS: 300-301, 303-313, 402, and 601-606.

TABLE 24

Additional Exemplary gene editing plasmids

| SEQ ID NO | Name | Sequence |
|---|---|---|
| 300 | pMGC 1m Annotated in pUC57 (pMGC) | tcgcgcgtttcggtgatgacggtgaaaacctctgacacatgcagctcccggagacggtca cagcttgtctgtaagcggatgccgggagcagacaagcccgtcagggcgcgtcagcgggtg ttggcgggtgtcggggctggcttaactatgcggcatcagagcagattgtactgagagtgc accatatgcggtgtgaaataccgcacagatgcgtaaggagaaaataccgcatcaggcgcc attcgccattcaggctgcgcaactgttgggaagggcgatcggtgcgggcctcttcgctat tacgccagctggcgaaaggggatgtgctgcaaggcgattaagttgggtaacgccagggt tttcccagtcacgacgttgtaaaacgacggccagtgaattcgagctcggtacctcgcgaa tgcatctagataacaggtctcaggctcgatttctttagggccgtaggctagtaatcatcg accgttttaatcattaatgtacttagacaataaatataagatgcaatacaagtcaatggg agaaactagacttttacaaaacctttaaaagccctggtgagatatgagaaggtttatgaca gaatatatcgccattaatgtgaggttgtggacactgctggtagtcaaggctgcccgtgaa ccatatttagtcacatgtaatcaccccgcgtgctaaacaaaaagcaaaatatcagtaaga tagtcacagtcataacactgttgaatgggtcttcgccggatccagtgctaacatggtcta gaaggaggtcagctatgcagtttaaggtttacacctataaaagagagagccgttatcgtc tgtttgtggatgtacagagtgatattattgacacgcccgggcgacggatggtgatccccc tggccagtgcacgtctgctgtcagataaagtctcccgtgaactttacccagtggtgcata tcggggatgaaagctggcgcatgatgaccaccgatatggccagtgtgccagtctccgtta tcggggaagaagtggctgatctcagccaccgcgaaaatgacatcaaaaacgccattaacc tgatgttctggggaatataactgcagaggaggtaatcaagaagacctgttttagagctag aaatagcaagttaaaataaggctagtccgttatcaacttgaaaaagtggcaccgagtcgg tgcttttttatgccacaacactggtggtacctcagtgagacctgttatcggatcccgggc ccgtcgactgcagaggcctgcatgcaagcttggcgtaatcatggtcatagctgtttcctg tgtgaaattgttatccgctcacaattccacacaacatacgagccgggaagcataaagtgta aagcctggggtgcctaatgagtgagctaactcacattaattgcgttgcgctcactgcccg ctttccagtcgggaaacctgtcgtgccagctgcattaatgaatcggccaacgcgcgggga gaggcggtttgcgtattgggcgctcttccgcttcctcgctcactgactcgctgcgctcgg tcgttcggctgcggcgagcggtatcagctcactcaaaggcggtaatacggttatccacag aatcaggggataacgcaggaaagaacatgtgagcaaaaggccagcaaaaggccaggaacc gtaaaaaggccgcgttgctggcgtttttccataggctccgcccccctgacgagcatcaca aaaatcgacgctcaagtcagaggtggcgaaacccgacaggactataaagataccaggcgt ttccccctggaagctccctcgtgcgctctcctgttccgaccctgccgcttaccggatacc tgtccgcctttctcccttcgggaagcgtggcgctttctcatagctcacgctgtaggtatc tcagttcggtgtaggtcgttcgctccaagctgggctgtgtgcacgaaccccccgttcagc ccgaccgctgcgccttatccggtaactatcgtcttgagtccaacccggtaagacacgact tatcgccactggcagcagccactggtaacaggattagcagagcgaggtatgtaggcggtg ctacagagttcttgaagtggtggcctaactacggctacactagaagaacagtatttggta tctgcgctctgctgaagccagttaccttcggaaaaagagttggtagctcttgatccggca aacaaaccaccgctggtagcggtggtttttttgtttgcaagcagcagattacgcgcagaa aaaaaggatctcaagaagatcctttgatcttttctacggggtctgacgctcagtggaacg aaaactcacgttaagggattttggtcatgagattatcaaaaaggatcttcacctagatcc ttttaaattaaaaatgaagttttaaatcaatctaaagtatatatgagtaaacttggtctg acagttaccaatgcttaatcagtgaggcacctatctcagcgatctgtctatttcgttcat ccatagttgcctgactccccgtcgtgtagataactacgatacgggagggcttaccatctg gccccagtgctgcaatgataccgcgagatccacgctcaccggctccagatttatcagcaa taaaccagccagccggaagggccgagcgcagaagtggtcctgcaactttatccgcctcca tccagtctattaattgttgccgggaagctagagtaagtagttcgccagttaatagtttgc gcaacgttgttgccattgctacaggcatcgtggtgtcacgctcgtcgtttggtatggctt cattcagctccggttcccaacgatcaaggcgagttacatgatccccatgttgtgcaaaa agcggttagctccttcggtcctccgatcgttgtcagaagtaagttggccgcagtgttat cactcatggttatggcagcactgcataattctcttactgtcatgccatccgtaagatgct ttctgtgactggtgagtactcaaccaagtcattctgagaatagtgtatgcggcgaccga gttgctcttgcccggcgtcaatacgggataataccgcgccacatagcagaactttaaaag tgctcatcattggaaaacgttcttcggggcgaaaactctcaaggatcttaccgctgttga gatccagttcgatgtaacccactcgtgcacccaactgatcttcagcatcttttactttca ccagcgtttctgggtgagcaaaaacaggaaggcaaaatgccgcaaaaaagggaataaggg cgacacggaaatgttgaatactcatactcttcctttttcaatattattgaagcatttatc agggttattgtctcatgagcggatacatatttgaatgtatttagaaaaataaacaaatag gggttccgcgcacatttccccgaaaagtgccacctgacgtctaagaaaccattattatca tgacattaacctataaaaataggcgtatcacgaggccctttcgtc |
| 301 | pMGC 2 Annotated | tcgcgcgtttcggtgatgacggtgaaaacctctgacacatgcagctcccggagacggtca cagcttgtctgtaagcggatgccgggagcagacaagcccgtcagggcgcgtcagcgggtg |

TABLE 24-continued

Additional Exemplary gene editing plasmids

| SEQ ID NO | Name | Sequence |
|---|---|---|
| | in pUC57 (pMGC) | ttggcgggtgtcggggctggcttaactatgcggcatcagagcagattgtactgagagtgc accatatgcggtgtgaaataccgcacagatgcgtaaggagaaaataccgcatcaggcgcc attcgccattcaggctgcgcaactgttgggaagggcgatcggtgcgggcctcttcgctat tacgccagctggcgaaaggggatgtgctgcaaggcgattaagttgggtaacgccagggt tttcccagtcacgacgttgtaaaacgacggccagtgaattcgagctcggtacctcgcgaa tgcatctagataacaggtctcaggcttgccaaaaagccttcttgtggcctgcttactatt aaggcaactaattcaagaacaagtgattctgggtaggtagatgccacagttcatgataat aaaggcgaagtcagaaggagtagtccgttgatgaagaaagcagaaggcaaggaatgttgg tggcttttggttgcggtagcactgaaaccgtgtccggacttcgccgggagcagacaatgg cttggttggattacataataatacccgcgggccagacaatattcaaaatcctaacaaag atgtctcaggtaatacattcgctaatgggtcttcgccggatccagtgctaacatggtcta gaaggaggtcagctatgcagtttaaggtttacacctataaaagagagagccgttatcgtc tgtttgtggatgtacagagtgatattattgacacgcccgggcgacggatggtgatccccc tggccagtgcacgtctgctgtcagataaagtctcccgtgaactttacccagtggtgcata tcggggatgaaagctggcgcatgatgaccaccgatatggccagtgtgccagtctccgtta tcggggaagaagtggctgatctcagccaccgcgaaatgacatcaaaaacgccattaacc tgatgttctgggaatataactgcagaggaggtaatcaagaagacctgttttagagctag aaatagcaagttaaaataaggctagtccgttatcaacttgaaaaagtggcaccgagtcgg tgcttttttatgccacaacactggtggtacctcagtgagacctgttatcggatcccgggc ccgtcgactgcagaggcctgcatgcaagcttggcgtaatcatggtcatagctgtttcctg tgtgaaattgttatccgctcacaattccacacaacatacgagccggaagcataaagtgta aagcctggggtgcctaatgagtgagctaactcacattaattgcgttgcgctcactgcccg ctttccagtcgggaaacctgtcgtgccagctgcattaatgaatcggccaacgcgcgggga gaggcggtttgcgtattgggcgctcttccgcttcctcgctcactgactcgctgcgctcgg tcgttcggctgcggcgagcggtatcagctcactcaaaggcggtaatacggttatccacag aatcaggggataacgcaggaaagaacatgtgagcaaaaggccagcaaaaggccaggaacc gtaaaaaggccgcgttgctggcgtttttccataggctccgcccccctgacgagcatcaca aaaatcgacgctcaagtcagaggtggcgaaacccgacaggactataaagataccaggcgt ttccccctggaagctccctcgtgcgctctcctgttccgaccctgccgcttaccggatacc tgtccgcctttctcccttcgggaagcgtggcgctttctcatagctcacgctgtaggtatc tcagttcggtgtaggtcgttcgctccaagctgggctgtgtgcacgaaccccccgttcagc ccgaccgctgcgccttatccggtaactatcgtcttgagtccaacccggtaagacacgact tatcgccactggcagcagccactggtaacaggattagcagagcgaggtatgtaggcggtg ctacagagttcttgaagtggtggcctaactacggctacactagaagaacagtatttggta tctgcgctctgctgaagccagttaccttcggaaaaagagttggtagctcttgatccggca aacaaaccaccgctggtagcggtggtttttttgtttgcaagcagcagattacgcgcagaa aaaaaggatctcaagaagatcctttgatcttttctacggggtctgacgctcagtggaacg aaaactcacgttaagggattttggtcatgagattatcaaaaaggatcttcacctagatcc ttttaaattaaaaatgaagttttaaatcaatctaaagtatatatgagtaaacttggtctg acagttaccaatgcttaatcagtgaggcacctatctcagcgatctgtctatttcgttcat ccatagttgcctgactccccgtcgtgtagataactacgatacgggagggcttaccatctg gccccagtgctgcaatgataccgcgagatccacgctcaccggctccagatttatcagcaa taaaccagccagccggaagggccgagcgcagaagtggtcctgcaactttatccgcctcca tccagtctattaattgttgccgggaagctagagtaagtagttcgccagttaatagtttgc gcaacgttgttgccattgctacaggcatcgtggtgtcacgctcgtcgtttggtatggctt cattcagctccggttcccaacgatcaaggcgagttacatgatccccatgttgtgcaaaa aagcggttagctccttcggtcctccgatcgttgtcagaagtaagttggccgcagtgttat cactcatggttatggcagcactgcataattctcttactgtcatgccatccgtaagatgct tttctgtgactggtgagtactcaaccaagtcattctgagaatagtgtatgcggcgaccga gttgctcttgcccggcgtcaatacgggataataccgcgccacatagcagaactttaaaag tgctcatcattggaaaacgttcttcggggcgaaaactctcaaggatcttaccgctgttga gatccagttcgatgtaacccactcgtgcacccaactgatcttcagcatcttttactttca ccagcgtttctgggtgagcaaaaacaggaaggcaaaatgccgcaaaaaagggaataaggg cgacacggaaatgttgaatactcatactcttcctttttcaatattattgaagcatttatc agggttattgtctcatgagcggatacatatttgaatgtatttagaaaaataacaaatag gggttccgcgcacatttccccgaaaagtgccacctgacgtctaagaaaccattattatca tgacattaacctataaaaataggcgtatcacgaggccctttcgtc |
| 402 | pMGC 11 Annotated in pUC57 (pMGC) | tcgcgcgtttcggtgatgacggtgaaaacctctgacacatgcagctcccggagacggtca cagcttgtctgtaagcggatgccgggagcagacaagcccgtcagggcgcgtcagcgggtg ttggcgggtgtcggggctggcttaactatgcggcatcagagcagattgtactgagagtgc accatatgcggtgtgaaataccgcacagatgcgtaaggagaaaataccgcatcaggcgcc attcgccattcaggctgcgcaactgttgggaagggcgatcggtgcgggcctcttcgctat tacgccagctggcgaaaggggatgtgctgcaaggcgattaagttgggtaacgccagggt tttcccagtcacgacgttgtaaaacgacggccagtgaattcgagctcggtacctcgcgaa tgcatctagataacaggtctcaggctggtaccagcagtaccagccagccactgcatta ttgaatctgacatctgcaacagcaaggtacaatttttgttttacattttactcattaata ttagcacctatagctgtggccaatcttttgacgacgactctctcacgctggaggaaagca tggtacgggcattaattgccagcgtagaacaagcgtaggatatgggcaacctcgctgatt tctatatttggtaagaagtctcacccccgtgagctaagcaaaaagcaaaaccccttgctatg tcaacatcccactgccatacactattgggtcttcgccggatccagtgctaacatggtcta gaaggaggtcagctatgcagtttaaggtttacacctataaaagagagagccgttatcgtc tgtttgtggatgtacagagtgatattattgacacgcccgggcgacggatggtgatccccc tggccagtgcacgtctgctgtcagataaagtctcccgtgaactttacccagtggtgcata tcggggatgaaagctggcgcatgatgaccaccgatatggccagtgtgccagtctccgtta |

TABLE 24-continued

Additional Exemplary gene editing plasmids

| SEQ ID NO | Name | Sequence |
|---|---|---|
| | | tcggggaagaagtggctgatctcagccaccgcgaaaatgacatcaaaaacgccattaacc tgatgttctggggaatataactgcagaggaggtaatcaagaagacctgttttagagctag aaatagcaagttaaaataaggctagtccgttatcaacttgaaaaagtggcaccgagtcgg tgcttttttatgccacaacactggtggtacctcagtgagacctgttatcggatcccgggc ccgtcgactgcagaggcctgcatgcaagcttggcgtaatcatggtcatagctgtttcctg tgtgaaattgttatccgctcacaattccacacaacatacgagccggaagcataaagtgta aagcctggggtgcctaatgagtgagctaactcacattaattgcgttgcgctcactgcccg ctttccagtcgggaaacctgtcgtgccagctgcattaatgaatcggccaacgcgcgggga gaggcggtttgcgtattgggcgctcttccgcttcctcgctcactgactcgctgcgctcgg tcgttcggctgcggcgagcggtatcagctcactcaaaggcggtaatacggttatccacag aatcaggggataacgcaggaaagaacatgtgagcaaaaggccagcaaaaggccaggaacc gtaaaaaggccgcgttgctggcgtttttccataggctccgcccccctgacgagcatcaca aaaatcgacgctcaagtcagaggtggcgaaacccgacaggactataaagataccaggcgt ttccccctggaagctccctcgtgcgctctcctgttccgaccctgccgcttaccggatacc tgtccgcctttctcccttcgggaagcgtggcgctttctcatagctcacgctgtaggtatc tcagttcggtgtaggtcgttcgctccaagctgggctgtgtgcacgaaccccccgttcagc ccgaccgctgcgccttatccggtaactatcgtcttgagtccaacccggtaagacacgact tatcgccactggcagcagccactggtaacaggattagcagagcgaggtatgtaggcggtg ctacagagttcttgaagtggtggcctaactacggctacactagaagaacagtatttggta tctgcgctctgctgaagccagttaccttcggaaaaagagttggtagctcttgatccggca aacaaaccaccgctggtagcggtggtttttttgtttgcaagcagcagattacgcgcagaa aaaaaggatctcaagaagatcctttgatcttttctacggggtctgacgctcagtggaacg aaaactcacgttaagggattttggtcatgagattatcaaaaaggatcttcacctagatcc ttttaaattaaaaatgaagttttaaatcaatctaaagtatatatgagtaaacttggtctg acagttaccaatgcttaatcagtgaggcacctatctcagcgatctgtctatttcgttcat ccatagttgcctgactccccgtcgtgtagataactacgatacgggagggcttaccatctg gccccagtgctgcaatgataccgcgagatccacgctcaccggctccagatttatcagcaa taaaccagccagccggaagggccgagcgcagaagtggtcctgcaactttatccgcctcca tccagtctattaattgttgccgggaagctagagtaagtagttcgccagttaatagtttgc gcaacgttgttgccattgctacaggcatcgtggtgtcacgctcgtcgtttggtatggctt cattcagctccggttcccaacgatcaaggcgagttacatgatccccatgttgtgcaaaa aagcggttagctccttcggtcctccgatcgttgtcagaagtaagttggccgcagtgttat cactcatggttatggcagcactgcataattctcttactgtcatgccatccgtaagatgct tttctgtgactggtgagtactcaaccaagtcattctgagaatagtgtatgcggcgaccga gttgctcttgcccggcgtcaatacgggataataccgcgccacatagcagaactttaaaag tgctcatcattggaaaacgttcttcggggcgaaaactctcaaggatcttaccgctgttga gatccagttcgatgtaacccactcgtgcacccaactgatcttcagcatcttttactttca ccagcgtttctgggtgagcaaaaacaggaaggcaaaatgccgcaaaaaagggaataaggg cgacacggaaatgttgaatactcatactcttcctttttcaatattattgaagcatttatc agggttattgtctcatgagcggatacatatttgaatgtatttagaaaaataaacaaatag gggttccgcgcacatttccccgaaaagtgccacctgacgtctaagaaaccattattatca tgacattaacctataaaaataggcgtatcacgaggccctttcgtc |
| 303 | pMGD 1m Annotated in pUC57 (pMGD) | tcgcgcgtttcggtgatgacggtgaaaacctctgacacatgcagctcccggagacggtca cagcttgtctgtaagcggatgccggagcagacaagcccgtcagggcgcgtcagcgggtg ttggcgggtgtcggggctggcttaactatgcggcatcagagcagattgtactgagagtgc accatatgcggtgtgaaataccgcacagatgcgtaaggagaaaataccgcatcaggcgcc attcgccattcaggctgcgcaactgttgggaagggcgatcggtgcgggcctcttcgctat tacgccagctggcgaaaggggatgtgctgcaaggcgattaagttgggtaacgccagggt tttcccagtcacgacgttgtaaaacgacggccagtgaattcgagctcggtacctcgcgaa tgcatctagataacaggtctcatcagcgatttctttagggccgtaggctagtaatcatcg accgttttaatcattaatgtacttagacaataaatataagatgcaatacaagtcaatggg agaaactagactttacaaaacctttaaaagcccggtgagatatgagaaggtttatgaca gaatatatcgccattaatgtgaggttgtggacactgctggtagtcaaggctgcccgtgaa ccatatttagtcacatgtaatcaccccgcgtgctaaacaaaagcaaaatatcagtaaga tagtcacagtcataacactgttgaatgggtcttcgccggatccagtgctaacatggtcta gaaggaggtcagctatgcagtttaaggtttacacctataaagagagagccgttatcgtc tgtttgtggatgtacagatgatattattgacacgcccgggcgcggatggtgatccccc tggccagtgcacgtctgctgtcagataaagtctcccgtgaactttacccagtggtgcata tcggggatgaaagctggcgcatgatgaccaccgatatggccagtgtgccagtctccgtta tcggggaagaagtggctgatctcagccaccgcgaaaatgacatcaaaaacgccattaacc tgatgttctggggaatataactgcagaggaggtaatcaagaagacctgttttagagctag aaatagcaagttaaaataaggctagtccgttatcaacttgaaaaagtggcaccgagtcgg tgcttttttatgccacaacactggtggtacctgctgagacctgttatcggatcccgggc ccgtcgactgcagaggcctgcatgcaagcttggcgtaatcatggtcatagctgtttcctg tgtgaaattgttatccgctcacaattccacacaacatacgagccggaagcataaagtgta aagcctggggtgcctaatgagtgagctaactcacattaattgcgttgcgctcactgcccg ctttccagtcgggaaacctgtcgtgccagctgcattaatgaatcggccaacgcgcgggga gaggcggtttgcgtattgggcgctcttccgcttcctcgctcactgactcgctgcgctcgg tcgttcggctgcggcgagcggtatcagctcactcaaaggcggtaatacggttatccacag aatcaggggataacgcaggaaagaacatgtgagcaaaaggccagcaaaaggccaggaacc gtaaaaaggccgcgttgctggcgtttttccataggctccgcccccctgacgagcatcaca aaaatcgacgctcaagtcagaggtggcgaaacccgacaggactataaagataccaggcgt ttccccctggaagctccctcgtgcgctctcctgttccgaccctgccgcttaccggatacc tgtccgcctttctcccttcgggaagcgtggcgctttctcatagctcacgctgtaggtatc |

TABLE 24-continued

Additional Exemplary gene editing plasmids

| SEQ ID NO | Name | Sequence |
|---|---|---|
| | | tcagttcggtgtaggtcgttcgctccaagctgggctgtgtgcacgaaccccccgttcagc ccgaccgctgcgccttatccggtaactatcgtcttgagtccaacccggtaagacacgact tatcgccactggcagcagccactggtaacaggattagcagagcgaggtatgtaggcggtg ctacagagttcttgaagtggtggcctaactacggctacactagaagaacagtatttggta tctgcgctctgctgaagccagttaccttcggaaaaagagttggtagctcttgatccggca aacaaaccaccgctggtagcggtggtttttttgtttgcaagcagcagattacgcgcagaa aaaaggatctcaagaagatcctttgatctttctacggggtctgacgctcagtggaacg aaaactcacgttaagggattttggtcatgagattatcaaaaaggatcttcacctagatcc ttttaaattaaaaatgaagttttaaatcaatctaaagtatatatgagtaaacttggtctg acagttaccaatgcttaatcagtgaggcacctatctcagcgatctgtctatttcgttcat ccatagttgcctgactccccgtcgtgtagataactacgatacgggagggcttaccatctg gccccagtgctgcaatgataccgcgagatccacgctcaccggctccagatttatcagcaa taaaccagccagccggaagggccgagcgcagaagtggtcctgcaactttatccgcctcca tccagtctattaattgttgccgggaagctagagtaagtagttcgcagttaatagtttgc gcaacgttgttgccattgctacaggcatcgtggtgtcacgctcgtcgtttggtatggctt cattcagctccggttcccaacgatcaaggcgagttacatgatcccccatgttgtgcaaaa aagcggttagctccttcggtcctccgatcgttgtcagaagtaagttggccgcagtgttat cactcatggttatggcagcactgcataattctcttactgtcatgccatccgtaagatgct tttctgtgactggtgagtactcaaccaagtcattctgagaatagtgtatgcggcgaccga gttgctcttgcccggcgtcaatacgggataataccgcgccacatagcagaactttaaaag tgctcatcattggaaaacgttcttcggggcgaaaactctcaaggatcttaccgctgttga gatccagttcgatgtaacccactcgtgcacccaactgatcttcagcatcttttactttca ccagcgtttctgggtgagcaaaaacaggaaggcaaaatgccgcaaaaaagggaataaggg cgacacggaaatgttgaatactcatactcttcctttttcaatattattgaagcatttatc agggttattgtctcatgagcggatacatatttgaatgtatttagaaaaataaacaaatag gggttccgcgcacatttccccgaaaagtgccacctgacgtctaagaaaccattattatca tgacattaacctataaaaataggcgtatcacgaggccctttcgtc |
| 304 | pMGD 2 Annotated in pUC57 (pMGD) | tcgcgcgtttcggtgatgacggtgaaaacctctgacacatgcagctcccggagacggtca cagcttgtctgtaagcggatgccgggagcagacaagcccgtcagggcgcgtcagcgggtg ttggcgggtgtcggggctggcttaactatgcggcatcagagcagattgtactgagagtgc accatatgcggtgtgaaataccgcacagatgcgtaaggagaaaataccgcatcaggcgcc attcgccattcaggctgcgcaactgttgggaagggcgatcggtgcgggcctcttcgctat tacgccagctggcgaaaggggatgtgctgcaaggcgattaagttgggtaacgccagggt tttcccagtcacgacgttgtaaaacgacggccagtgaattcgagctcggtacctcgcgaa tgcatctagataacaggtctcatcagtgccaaaagccttcttgtggcctgcttactatt aaggcaactaattcaagaacaagtgattctgggtaggtagatgccacagttcatgataat aaaggcgaagtcagaaggagtagtccgttgatgaagaaagcagaaggcaaggaatgttgg tggcttttggttgcggtagcactgaaaccgtgtccggacttcgccgggagcagacaatgg cttggttggattacataataataccccgcgggccagacaatattcaaaatcctaacaaag atgtctcaggtaatacattcgctaatgggtcttcgccggatccagtgctaacatggtcta gaaggaggtcagctatgcagtttaaggtttacacctataaaagagagccgttatcgtc tgtttgtggatgtacagagtgatattattgacacgcccgggcgacggatggtgatccccc tggccagtgcacgtctgctgtcagataaagtctcccgtgaactttacccagtggtgcata tcggggatgaaagctggcgcatgatgaccaccgatatggccagtgtgccagtctccgtta tcggggaagaagtggctgatctcagccaccgcgaaatgacatcaaaaacgccattaacc tgatgttctgggaatataactgcagaggaggtaatcaagaagacctgttttagagctag aaatagcaagttaaaataaggctagtccgttatcaacttgaaaaagtggcaccgagtcgg tgcttttttatgccacaacactggtggtaccctgctgagacctgttatcggatcccggc ccgtcgactgcagaggcctgcatgcaagcttggcgtaatcatggtcatagctgtttcctg tgtgaaattgttatccgctcacaattccacacaacatacgagccggaagcataaagtgta aagcctggggtgcctaatgagtgagctaactcacattaattgcgttgcgctcactgcccg ctttccagtcgggaaacctgtcgtgccagctgcattaatgaatcggccaacgcgcgggga gaggcggtttgcgtattgggcgctcttccgcttcctcgctcactgactcgctgcgctcg tcgttcggctgcggcgagcggtatcagctcactcaaaggcggtaatacggttatccacag aatcaggggataacgcaggaaagaacatgtgagcaaaaggccagcaaaaggccaggaacc gtaaaaaggccgcgttgctggcgtttttccataggctccgcccccctgacgagcatcaca aaaatcgacgctcaagtcagaggtggcgaaacccgacaggactataaagataccaggcgt ttccccctggaagctccctcgtgcgctctcctgttccgaccctgccgcttaccggatacc tgtccgcctttctcccttcgggaagcgtggcgctttctcatagctcacgctgtaggtatc tcagttcggtgtaggtcgttcgctccaagctgggctgtgtgcacgaaccccccgttcagc ccgaccgctgcgccttatccggtaactatcgtcttgagtccaacccggtaagacacgact tatcgccactggcagcagccactggtaacaggattagcagagcgaggtatgtaggcggtg ctacagagttcttgaagtggtggcctaactacggctacactagaagaacagtatttggta tctgcgctctgctgaagccagttaccttcggaaaaagagttggtagctcttgatccggca aacaaaccaccgctggtagcggtggtttttttgtttgcaagcagcagattacgcgcagaa aaaaggatctcaagaagatcctttgatctttctacggggtctgacgctcagtggaacg aaaactcacgttaagggattttggtcatgagattatcaaaaaggatcttcacctagatcc ttttaaattaaaaatgaagttttaaatcaatctaaagtatatatgagtaaacttggtctg acagttaccaatgcttaatcagtgaggcacctatctcagcgatctgtctatttcgttcat ccatagttgcctgactccccgtcgtgtagataactacgatacgggagggcttaccatctg gccccagtgctgcaatgataccgcgagatccacgctcaccggctccagatttatcagcaa taaaccagccagccggaagggccgagcgcagaagtggtcctgcaactttatccgcctcca tccagtctattaattgttgccgggaagctagagtaagtagttcgcagttaatagtttgc gcaacgttgttgccattgctacaggcatcgtggtgtcacgctcgtcgtttggtatggctt |

TABLE 24-continued

Additional Exemplary gene editing plasmids

| SEQ ID NO | Name | Sequence |
|---|---|---|
| | | cattcagctccggttcccaacgatcaaggcgagttacatgatcccccatgttgtgcaaaa aagcggttagctccttcggtcctccgatcgttgtcagaagtaagttggccgcagtgttat cactcatggttatggcagcactgcataattctcttactgtcatgccatccgtaagatgct tttctgtgactggtgagtactcaaccaagtcattctgagaatagtgtatgcggcgaccga gttgctcttgcccggcgtcaatacgggataataccgcgccacatagcagaactttaaaag tgctcatcattggaaaacgttcttcggggcgaaaactctcaaggatcttaccgctgttga gatccagttcgatgtaacccactcgtgcacccaactgatcttcagcatcttttactttca ccagcgtttctgggtgagcaaaaacaggaaggcaaaatgccgcaaaaaagggaataaggg cgacacgaaatgttgaatactcatactcttccttttcaatattattgaagcatttatc agggttattgtctcatgagcggatacatatttgaatgtatttagaaaaataaacaaatag gggttccgcgcacatttccccgaaaagtgccacctgacgtctaagaaaccattattatca tgacattaacctataaaaataggcgtatcacgaggccctttcgtc |
| 305 | pMGD 11 Annotated in pUC57 (pMGD) | tcgcgcgtttcggtgatgacggtgaaaacctctgacacatgcagctcccggagacggtca cagcttgtctgtaagcggatgccgggagcagacaagcccgtcagggcgcgtcagcgggtg ttggcgggtgtcggggctggcttaactatgcggcatcagagcagattgtactgagagtgc accatatgcggtgtgaaataccgcacagatgcgtaaggagaaaataccgcatcaggcgcc attcgccattcaggctgcgcaactgttgggaagggcgatcggtgcgggcctcttcgctat tacgccagctggcgaaaggggggatgtgctgcaaggcgattaagttgggtaacgccaggt tttcccagtcacgacgttgtaaaacgacggccagtgaattcgagctcggtacctcgcgaa tgcatctagataacaggtctcatcaggtaccagcagtaccagcaccagccactgcatta ttgaatctgacatctgcaacagcaaggtacaattttttgttttacattttactcattaata ttagcacctatagctgtggccaatcttttgacgacgactctctcacgctggaggaaagca tggtacgggcattaattgccagcgtagaacaagcgtaggatatgggcaacctcgctgatt tctatatttggtaagaagtctcaccccgtgagctaagcaaaaagcaaaaccctgctatg tcaacatcccactgccatacactatgggtcttcgccggatccagtgctaacatggtcta gaaggaggtcagctatgcagtttaaggtttacacctataaagagagagccgttatcgtc tgtttgtggatgtacagagtgatattattgacacgcccgggcgacggatggtgatccccc tggccagtgcacgtctgctgtcagataaagtctcccgtgaactttacccagtggtgcata tcggggatgaaagctggcgcatgatgaccaccgatatggccagtgtgccagtctccgtta tcggggaagaagtggctgatctcagccaccgcgaaaatgacatcaaaaacgccattaacc tgatgttctggggaatataactgcagaggaggtaatcaagaagacctgttttagagctag aaatagcaagttaaaataaggctagtccgttatcaacttgaaaaagtggcaccgagtcgg tgcttttttatgccacaacactggtggtaccctgctgagacctgttatcggatcccgggc ccgtcgactgcagaggcctgcatgcaagcttggcgtaatcatggtcatagctgtttcctg tgtgaaattgttatccgctcacaattccacacaacatacgagccggaagcataaagtgta aagcctggggtgcctaatgagtgagctaactcacattaattgcgttgcgctcactgcccg ctttccagtcgggaaacctgtcgtgccagctgcattaatgaatcggccaacgcgcgggga gaggcggtttgcgtattgggcgctcttccgcttcctcgctcactgactcgctgcgctcgg tcgttcggctgcggcgagcggtatcagctcactcaaaggcggtaatacggttatccacag aatcaggggataacgcaggaaagaacatgtgagcaaaaggccagcaaaaggccaggaacc gtaaaaaggccgcgttgctggcgttttccataggctccgcccccctgacgagcatcaca aaaatcgacgctcaagtcagaggtggcgaaacccgacaggactataaagataccaggcgt ttccccctggaagctccctcgtgcgctctcctgttccgaccctgccgcttaccggatacc tgtccgccttctccccttcgggaagcgtggcgctttctcatagctcacgctgtaggtatc tcagttcggtgtaggtcgttcgctccaagctgggctgtgtgcacgaaccccccgttcagc ccgaccgctgcgccttatccggtaactatcgtcttgagtccaacccggtaagacacgact tatcgccactggcagcagccactggtaacaggattagcagagcgaggtatgtaggcggtg ctacagagttcttgaagtggtggcctaactacggctacactagaagaacagtatttggta tctgcgctctgctgaagccagttaccttcggaaaaagagttggtagctcttgatccggca aacaaaccaccgctggtagcggtggtttttttgtttgcaagcagcagattacgcgcagaa aaaaaggatctcaagaagatcctttgatcttttctacggggtctgacgctcagtggaacg aaaactcacgttaagggattttggtcatgagattatcaaaaaggatcttcacctagatcc ttttaaattaaaaatgaagttttaaatcaatctaaagtatatatgagtaaacttggtctg acagttaccaatgcttaatcagtgaggcacctatctcagcgatctgtctatttcgttcat ccatagttgcctgactccccgtcgtgtagataactacgatacgggagggcttaccatctg gccccagtgctgcaatgataccgcgagatccacgctcaccggctccagatttatcagcaa taaaccagccagccggaagggccgagcgcagaagtggtcctgcaactttatccgcctcca tccagtctattaattgttgccgggaagctagagtaagtagttcgccagttaatagtttgc gcaacgttgttgccattgctacaggcatcgtggtgtcacgctcgtcgtttggtatggctt cattcagctccggttcccaacgatcaaggcgagttacatgatcccccatgttgtgcaaaa aagcggttagctccttcggtcctccgatcgttgtcagaagtaagttggccgcagtgttat cactcatggttatggcagcactgcataattctcttactgtcatgccatccgtaagatgct tttctgtgactggtgagtactcaaccaagtcattctgagaatagtgtatgcggcgaccga gttgctcttgcccggcgtcaatacgggataataccgcgccacatagcagaactttaaaag tgctcatcattggaaaacgttcttcggggcgaaaactctcaaggatcttaccgctgttga gatccagttcgatgtaacccactcgtgcacccaactgatcttcagcatcttttactttca ccagcgtttctgggtgagcaaaaacaggaaggcaaaatgccgcaaaaaagggaataaggg cgacacgaaatgttgaatactcatactcttccttttcaatattattgaagcatttatc agggttattgtctcatgagcggatacatatttgaatgtatttagaaaaataaacaaatag gggttccgcgcacatttccccgaaaagtgccacctgacgtctaagaaaccattattatca tgacattaacctataaaaataggcgtatcacgaggccctttcgtc |
| 306 | pMGE Cas9 | tcgcgcgtttcggtgatgacggtgaaaacctctgacacatgcagctcccggagacggtca cagcttgtctgtaagcggatgccgggagcagacaagcccgtcagggcgcgtcagcgggtg |

TABLE 24-continued

Additional Exemplary gene editing plasmids

| SEQ ID NO | Name | Sequence |
|---|---|---|
| | Annotated in pUC57 (pMGE) | ttggcgggtgtcggggctggcttaactatgcggcatcagagcagattgtactgagagtgc
accatatgcggtgtgaaataccgcacagatgcgtaaggagaaaataccgcatcaggcgcc
attcgccattcaggctgcgcaactgtgggaagggcgatcggtgcgggcctcttcgctat
tacgccagctggcgaaaggggatgtgctgcaaggcgattaagttgggtaacgccagggt
tttcccagtcacgacgttgtaaaacgacggccagtgaattcgagctcggtacctcgcgaa
tgcatctagataacaggtctcactgcgagctctgaaagacgcagccgacggtaaacaccc
gggcatcgagaaaggcattgtcgactatacggaagaagacgttgtttccaccgatttcgt
tgggagcaactattcgatgatctttgacgcaaaagcgggcatcgcgttgaactcgcgttt
tatgaaattagttgcatggtatgataatgagtggggatatgcgcgtagagtctgcgatga
ggttgtgtatgtagcgaagaagaattaagaggtccgcaagtagattgaaagttcagtacg
tttttaacaatagagcattttcgaggcttgcgtcattctgtgtcaggctagcagtttata
agcgttgaggatctagagctgctgttcccgcgtctcgaatgttctcggtgttagggggtt
agcaatctgatatgataataatttgtgatgacatcgatagtacaaaaaccccaattccgg
tcacatccaccatctccgttttctcccatctacacacaacaagctcatcgccggtaccat
ggtttgtctctcgcttgcataccacccagcagctcactgatgtcgacttgtaggttaaag
attataaagatcatgatggagattataaagatcatgatatcgattataaagatgatgatg
ataaagcagcaccaaaaaaaaaagaaaagtcggaatccatggagtcccagcagcagata
aaaaatattcaatcggattggatatcggaacaaactcagtcggatgggcagtcatcacag
atgaatataaagtcccatcaaaaaaattcaaagtcttgggaaacacagatagacattcaa
tcaaaaaaaacttgatcggagcattgttgttcgattcaggagaaacagcagaagcaacaa
gattgaaaagaacagcagaagaagatatacaagaagaaaaaacagaatctgctatttgc
aagaaatcttctcaaacgaaatggcaaaagtcgatgattcattcttccatagattggaag
aatcattcttggtcgaagaagataaaaaacatgaaagacatccaatcttcggaaacatcg
tcgatgaagtcgcatatcatgaaaaatatccaacaatctatcatttgagaaaaaaattgg
tcgattcaacagataaagcagatttgagattgatctatttggcattggcacatatgatca
aattcagaggacatttcttgatcgaaggagatttgaacccagataactcagatgtcgata
aattgttcatccaattggtccaaacatataaccaattgttcgaagaaaacccaatcaacg
catcaggagtcgatgcaaaagcaatcttgtcagcaagattgtcaaaatcaagaagattgg
aaaacttgatcgcacaattgccaggagaaaaaaaaaacggattgttcggaaacttgatcg
cattgtcattgggattgacaccaaacttcaaatcaaacttcgatttggcagaagatgcaa
aattgcaattgtcaaaagatacatatgatgatgatttggataacttgttggcacaaatcg
gagatcaatatgcagatttgttcttggcagcaaaaaacttgtcagatgcaatcttgttgt
cagatatcttgagagtcaacacagaaatcacaaaagcaccattgtcagcatcaatgatca
aaagatatgatgaacatcatcaagatttgacattgttgaaagcattggtcagacaacaat
tgccagaaaaatataaagaaatcttcttcgatcaatcaaaaaaacggatatgcaggatata
tcgatggaggagcatcacaagaagaattctataaattcatcaaaccaatcttggaaaaaa
tggatgaacagaagaattgttggtcaaattgaacagagaagatttgttgagaaaacaaa
gaacattcgataacggatcaatcccacatcaaatccatttgggagaattgcatgcaatct
tgagaagacaagaagatttctatccattcttgaaagataacagagaaaaaatcgaaaaaa
tcttgacattcagaatcccatattatgtcggaccattggcaagaggaaactcaagattcg
catggatgacaagaaaatcagaagaaacaatcacaccatggaagtcgaagaagtcgtcg
ataaaggagcatcagcacaatcattcatcgaaagaatgacaaacttcgataaaaaacttgc
caaacgaaaaagtcttgccaaaacattcattgttgtatgaatatttcacagtctataacg
aattgacaaaagtcaaatatgtcacagaaggaatgagaaaaccagcattcttgtcaggag
aacaaaaaaaagcaatcgtcgatttgttgttcaaacaaacagaaaagtcacagtcaaac
aattgaaagaagattatttcaaaaaaaatcgaatgcttcgattcagtcgaaatctcaggag
tcgaagatagattcaacgcatcattgggaacatatcatgatttgttgaaaatcatcaaag
ataaagatttcttggataacgaagaaaacgaagatatcttggaagatatcgtcttgacat
tgacattgttcgaagatagagaaatgatcgaagaaagattgaaaacatatgcacattgt
tcgatgataaagtcatgaaacaattgaaaagaagaagatatacaggatggggaagattgt
caagaaaattgatcaacggaatcagagataaacaatcaggaaaaacaatcttggatttct
tgaaatcagatggattcgcaaacagaaacttcatgcaattgatccatgatgattcattga
cattcaaagaagatatccaaaaagcacaagtctcaggacaaggagattcattgcatgaac
atatcgcaaacttggcaggatcaccagcaatcaaaaaaggaatcttgcaaacagtcaaag
tcgtcgatgaattggtcaaagtcatgggaagacataaaccagaaacatcgtcatccgaaa
tggcaagagaaaaccaaacaacacaaaaaggacaaaaaaaactcaagagaaagaatgaaaa
gaatcgaagaaggaatcaaagaattgggatcacaaatcttgaaagaacatccagtcgaaa
acacacaattgcaaaacgaaaaattgtatttgtattatttgcaaaacggaagagatatgt
atgtcgatcaagaattggatatcaacagattgtcagattatgatgtcgatcatatcgtcc
cacaatcattcttgaaagatgattcaatcgataacaaagtcttgacaagatcagataaaa
acagaggaaaatcagataacgtcccatcagaagaagtcgtcaaaaaaatgaaaaactatt
ggagacaattgttgaacgcaaaattgatcacacaaagaaaattcgataacttgacaaaag
cagaaagaggaggattgtcagaattggataaagcaggattcatcaaaagacaattggtcg
aaacaagacaaatcacaaaacatgtcgcacaaatcttggattcaagaatgaacacaaaat
atgatgaaacgataaattgatcagagaagtcaaagtcatcacattgaaatcaaaattgg
tttcagatttcagaaagatttccaattctataaagtcagagaaatccaacaactatcatc
atgcacatgatgcatatttgaacgcagtcgtcggaacagcattgatcaaaaaatatccaa
aattggaatcagaattcgtctatggagattataaagtctatgatgtcagaaaatgatcg
caaaatcagaacaagaaatcggaaaagcaacagcaaaatatttcttctattcaaacatca
tgaacttcttcaaaacagaaatcacattggcaaacggagaaatcagaaaaagaccattga
tcgaaacaaacggagaaacaggagaaatcgtctgggataaaggagagattctcgcaacag
tcagaaaagtcttgtcaatgccacaagtcaacatcgtcaaaaaaaacagaagtccaaacag
gaggattctcaaaagaatcaatcttgccaaaaagaaactcagataaattgatcgcaagaa
aaaaagattgggatccaaaaaaaatatggaggattcgattcaccaacagtcgcatattcag
tcttggtcgtcgcaaaagtcgaaaaaggaaaatcaaaaaaattgaaatcagtcaaagaat |

TABLE 24-continued

Additional Exemplary gene editing plasmids

| SEQ ID NO | Name | Sequence |
|---|---|---|
| | | tgttgggaatcacaatcatggaaagatcatcattcgaaaaaaacccaatcgatttcttgg<br>aagcaaaaggatataaagaagtcaaaaaagatttgatcatcaaattgccaaaatattcat<br>tgttcgaattggaaaacggaagaaaaagaatgttggcatcagcaggagaattgcaaaag<br>gaaacgaattggcattgccatcaaaatatgtcaacttcttgtatttggcatcacattatg<br>aaaaattgaaaggatcaccagaagataacgaacaaaaacaattgttcgtcgaacaacata<br>aacattatttggatgaaatcatcgaacaaatctcagaattctcaaaaagagtcatcttgg<br>cagatgcaaacttggataaagtcttgtcagcatataacaaacatagagataaaccaatca<br>gagaacaagcagaaaacatcatccatttgttcacattgacaaacttgggagcaccagcag<br>cattcaaatatttcgatacaacaatcgatagaaaaagatatacatcaacaaaagaagtct<br>tggatgcaacattgatccatcaatcaatcacaggattgtatgaaacaagaatcgatttgt<br>cacaattgggaggagatggaatccatggagtcccagcagcaccaaaaaaaaaagaaaag<br>tctgaagtagatgccgaccggatctgtcgatcgacaagctcgagtttctccataataatg<br>tgtgagtagttcccagataagggaattagggttcctatagggtttcgctcatgtgttgag<br>catataagaaacccttagtatgtatttgtatttgtaaaatacttctatcaataaaatttc<br>taattcctaaaaccaaaatccagtactaaaatccagatcactatgagacctgttatcgga<br>tcccgggcccgtcgactgcagaggcctgcatgcaagcttggcgtaatcatggtcatagct<br>gtttcctgtgtgaaattgttatccgctcacaattccacacaacatacgagccggaagcat<br>aaagtgtaaagcctggggtgcctaatgagtgagctaactcacattaattgcgttgcgctc<br>actgcccgctttccagtcgggaaacctgtcgtgccagctgcattaatgaatcggccaacg<br>cgcggggagaggcggtttgcgtattgggcgctcttccgcttcctcgctcactgactcgct<br>gcgctcggtcgttcggctgcggcgagcggtatcagctcactcaaaggcggtaatacggtt<br>atccacagaatcaggggataacgcaggaaagaacatgtgagcaaaaggccagcaaaaggc<br>caggaaccgtaaaaaggccgcgttgctggcgtttttccataggctccgcccccctgacga<br>gcatcacaaaaatcgacgctcaagtcagaggtggcgaaacccgacaggactataaagata<br>ccaggcgtttccccctggaagctccctcgtgcgctctcctgttccgaccctgccgcttac<br>cggatacctgtccgcctttctcccttcgggaagcgtggcgctttctcatagctcacgctg<br>taggtatctcagttcggtgtaggtcgttcgctccaagctgggctgtgtgcacgaaccccc<br>cgttcagcccgaccgctgcgccttatccggtaactatcgtcttgagtccaacccggtaag<br>acacgacttatcgccactggcagcagccactggtaacaggattagcagagcgaggtatgt<br>aggcggtgctacagagttcttgaagtggtggcctaactacggctacactagaagaacagt<br>atttggtatctgcgctctgctgaagccagttaccttcggaaaaagagttggtagctcttg<br>atccggcaaacaaaccaccgctggtagcggtggtttttttgtttgcaagcagcagattac<br>gcgcagaaaaaaaggatctcaagaagatcctttgatcttttctacggggtctgacgctca<br>gtggaacgaaaactcacgttaagggattttggtcatgagattatcaaaaaggatcttcac<br>ctagatccttttaaattaaaaatgaagttttaaatcaatctaaagtatatatgagtaaac<br>ttggtctgacagttaccaatgcttaatcagtgaggcacctatctcagcgatctgtctatt<br>tcgttcatccatagttgcctgactccccgtcgtgtagataactacgatacgggagggctt<br>accatctggccccagtgctgcaatgataccgcgagatccacgctcaccggctccagattt<br>atcagcaataaaccagccagccggaagggccgagcgcagaagtggtcctgcaactttatc<br>cgcctccatccagtctattaattgttgccgggaagctagagtaagtagttcgccagttaa<br>tagtttgcgcaacgttgttgccattgctacaggcatcgtggtgtcacgctcgtcgtttgg<br>tatgcttcattcagctccggttcccaacgatcaaggcgagttacatgatcccccatgtt<br>gtgcaaaaaagcggttagctccttcggtcctccgatcgttgtcagaagtaagttggccgc<br>agtgttatcactcatggttatggcagcactgcataattctcttactgtcatgccatccgt<br>aagatgcttttctgtgactggtgagtactcaaccaagtcattctgagaatagtgtatgcg<br>gcgaccgagttgctcttgcccggcgtcaatacgggataataccgcgccacatagcagaac<br>tttaaaagtgctcatcattggaaaacgttcttcggggcgaaaactctcaaggatcttacc<br>gctgttgagatccagttcgatgtaacccactcgtgcacccaactgatcttcagcatcttt<br>tactttcaccagcgtttctgggtgagcaaaaacaggaaggcaaaatgccgcaaaaaaggg<br>aataagggcgacacggaaatgttgaatactcatactcttcctttttcaatattattgaag<br>catttatcagggttattgtctcatgagcggatacatatttgaatgtatttagaaaaataa<br>acaaataggggttccgcgcacatttccccgaaaagtgccacctgacgtctaagaaaccat<br>tattatcatgacattaacctataaaaataggcgtatcacgaggccctttcgtc |
| 307 | pMGE-<br>nCas9<br>Annotated<br>in pUC57<br>(pMGE) | tcgcgcgtttcggtgatgacggtgaaaacctctgacacatgcagctcccggagacggtca<br>cagcttgtctgtaagcggatgccgggagcagacaagcccgtcagggcgcgtcagcgggtg<br>ttggcgggtgtcggggctggcttaactatgcggcatcagagcagattgtactgagagtgc<br>accatatgcggtgtgaaataccgcacagatgcgtaaggagaaaataccgcatcaggcgcc<br>attcgccattcaggctgcgcaactgttgggaagggcgatcggtgcgggcctcttcgctat<br>tacgccagctggcgaaaggggatgtgctgcaaggcgattaagttgggtaacgccagggt<br>tttcccagtcacgacgttgtaaaacgacggccagtgaattcgagctcggtacctcgcgaa<br>tgcatctagataacaggtctcactgcgagctctgaaagacgcagccgacggtaaacaccc<br>gggcatcgagaaaggcattgtcgactatacggaagaagacgttgtttccaccgatttcgt<br>tgggagcaactattcgatgatctttgacgcaaaagcgggcatcgcgttgaactcgcgttt<br>tatgaaattagttgcatggtatgataatgagtggggatatgcgcgtagagtctgcgatga<br>ggttgtgtatgtagcgaagaagaattaagaggtccgcaagtagattgaaagttcagtacg<br>tttttaacaatagagcattttcgaggcttgcgtcattctgtgtcaggctagcagtttata<br>agcgttgaggatctagagctgctgttccgcgctctcgaatgttctcggtgtttaggggtt<br>agcaatctgatatgataataatttgtgatgacatcgatagtacaaaaaccccaattccgg<br>tcacatccaccatctccgttttctcccatctacacacaacaagctcatcgccggtaccat<br>ggtttgtctctcgcttgcataccacccagcagctcactgatgtcgacttgtaggttaaag<br>attataaagatcatgatggagattataaagatcatgatatcgattataaagatgatgatg<br>ataaagcagcaccaaaaaaaaagaaaagtcggaatccatggagtcccagcagcagata<br>aaaaatattcaatcggattggcaatcggaacaaactcagtcggatgggcagtcatcacag<br>atgaatataaagtcccatcaaaaaaattcaaagtcttgggaaacacagatagacattcaa |

TABLE 24-continued

Additional Exemplary gene editing plasmids

| SEQ ID NO | Name | Sequence |
|---|---|---|
| | | tcaaaaaaaacttgatcggagcattgttgttcgattcaggagaaacagcagaagcaacaa
gattgaaaagaacagcaagaagaagatatacaagaagaaaaaacagaatctgctatttgc
aagaaatcttctcaaacgaaatggcaaaagtcgatgattcattcttccatagattggaag
aatcattcttggtcgaagaagataaaaaacatgaaagacatccaatcttcggaaacatcg
tcgatgaagtcgcatatcatgaaaaatatccaacaatctatcatttgagaaaaaaattgg
tcgattcaacagataaagcagatttgagattgatctatttggcattggcacatatgatca
aattcagaggacatttcttgatcgaaggagatttgaacccagataactcagatgtcgata
aattgttcatccaattggtccaaacatataaccaattgttcgaagaaaacccaatcaacg
catcaggagtcgatgcaaaagcaatcttgtcagcaagattgtcaaaatcaagaagattgg
aaaacttgatcgcacaattgccaggagaaaaaaaaacggattgttcggaaacttgatcg
cattgtcattgggattgacaccaaacttcaaatcaaacttcgatttggcagaagatgcaa
aattgcaattgtcaaaagatacatatgatgatgatttggataacttgttggcacaaatcg
gagatcaatatgcagatttgttcttggcagcaaaaaacttgtcagatgcaatcttgttgt
cagatatcttgagagtcaacacagaaatcacaaaagcaccattgtcagcatcaatgatca
aaagatatgatgaacatcatcaagatttgacattgttgaaagcattggtcagacaacaat
tgccagaaaaatataaagaaatcttcttcgatcaatcaaaaaacggatatgcaggatata
tcgatggaggagcatcacaagaagaattctataaattcatcaaaccaatcttggaaaaaa
tggatggaacagaagaattgttggtcaaattgaacagagaagattgttgagaaaacaaa
gaacattcgataacggatcaatcccacatcaaatccatttgggagaattgcatgcaatct
gagaagacaagaagatttctatccattcttgaaagataacagagaaaaaatcgaaaaaa
tcttgacattcagaatcccatattgtgtcggaccattggcaagaggaaactcaagattcg
catggatgacaagaaaatcagaagaaacaatcacaccatggaacttcgaagaagtcgtcg
ataaaggagcatcagcacaatcattcatcgaaagaatgacaaacttcgataaaaacttgc
caaacgaaaagtcttgccaaaacattcattgttgtatgaatatttcacagtctataacg
aattgacaaaagtcaaatatgtcacagaaggaatgagaaaaccagcattcttgtcaggag
aacaaaaaaaagcaatcgtcgatttgttgttcaaaacaaacagaaaagtcacagtcaaac
aattgaaagaagattatttcaaaaaaatcgaatgcttcgattcagtcgaaatctcaggag
tcgaagatagattcaacgcatcattgggaacatatcatgatttgttgaaaatcatcaaag
ataaagatttcttggataacgaagaaaacgaagatatcttggaagatatcgtcttgacat
tgacattgttcgaagatagagaaatgatcgaagaaagattgaaaacatatgcacattgt
tcgatgataaagtcatgaaacaattgaaaagaagaagatatacaggatggggaagattgt
caagaaaattgatcaacggaatcagagataaacaatcaggaaaaacaatcttggatttct
tgaaatcagatgattcgcaaacagaaacttcatgcaattgatccatgatgattcattga
cattcaaagaagatatccaaaaagcacaagtctcaggacaaggagattcattgcatgaac
atatcgcaaacttggcaggatcaccagcaatcaaaaaaggaatcttgcaaacagtcaaag
tcgtcgatgaattggtcaaagtcatgggaagacataaaccagaaaacatcgtcatcgaaa
tggcaagagaaaaccaaacaacagaaaaaggacaaaaaaactcaagagaaagaatgaaaa
gaatcgaagaaggaatcaaagaattgggatcacaaatcttgaaagaacatccagtcgaaa
acacacaattgcaaaacgaaaaattgtatttgtattatttgcaaaacggaagagatatgt
atgtcgatcaagaattggatatcaacagattgtcagattatgatgtcgatcatatcgtcc
cacaatcattcttgaaagatgattcaatcgataacaaagtcttgacaagatcagataaaa
acagaggaaaatcagataacgtcccatcagaagaagtcgtcaaaaaaatgaaaaactatt
ggagacaattgttgaacgcaaaattgatcacacaaagaaaattcgataacttgacaaaag
cagaaagaggaggattgtcagaattggataaagcaggattcatcaaaagacaattggtcg
aaacaagacaaatcacaaaacatgtcgcacaaatcttggattcaagaatgaacacaaaat
atgatgaaaacgataaaattgatcagagaagtcaaagtcatcacattgaaatcaaaattgg
tttcagatttcagaaaagatttccaattctataaagtcagagaaatcaacaactatcatc
atgcacatgatgcatatttgaacgcagtcgtcggaacagcattgatcaaaaaatatccaa
aattggaatcagaattcgtctatggagattataaagtctatgatgtcagaaaaatgatcg
caaaatcagaacaagaaatcggaaaagcaacagcaaaatattcttctattcaaacatca
tgaacttcttcaaaacagaaatcacattggcaaacggagaaatcagaaaaagaccattga
tcgaaacaaacgagaaacaggagaaatcgtctgggataaaggaagagattcgcaacag
tcagaaaagtcttgtcaatgccacaagtcaacatcgtcaaaaaaacagaagtccaaacag
gaggattctcaaaagaatcaatcttgccaaaaagaaactcaggataaattgatcgcaaga
aaaaagattgggatccaaaaaaatatggaggattcgattcaccaacagtcgcatattcag
tcttggtcgtcgcaaaagtcgaaaaaggaaaatcaaaaaaattgaaatcagtcaaagaat
tgttgggaatcacaatcatgaaagatcatcattcgaaaaaaacccaatcgatttcttgg
aagcaaaaggatataaagaagtcaaaaaagatttgatcatcaaattgccaaaatattcat
tgttcgaattggaaaacggaagaaaaagaatgttggcatcagcaggagaattgcaaaaag
gaaacgaattggcattgccatcaaaatatgtcaacttcttgtatttggcatcacatttatg
aaaaattgaaaggatcaccagaagataacgaacaaaaacaattgttcgtcgaacaacata
aacattcatttggatgaaatcatcgaacaaatctcagaattctcaaaagagagtcatcttg
cagatgcaaacttggataaagtcttgtcagcatataacaaacatagagataaaccaatca
gagaacaagcagaaaacatcatccatttgttcacattgacaaacttgggagcaccagcag
cattcaaatatttcgatacaacaatcgatagaaaagatatacatcaacaaagaagtct
tggatgcaacattgatccatcaatcaatcacaggattgtatgaaacaagaatcgatttgt
cacaattgggaggagatggaatccatggagtcccagcagcaccaaaaaaaaaaagaaaag
tctgaagtagatgccgaccggatctgtcgatcgacaagctcgagtttctccataatatg
tgtgagtagtcccagataagggaattagggttcctatagggtttcgctcatgtgttgag
catataagaaacccttagtatgtatttgtatttgtaaaatacttctatcaataaaatttc
taattcctaaaaccaaaatccagtactaaaatccagatcactatgagacctgttatcgga
tcccgggcccgtcgactgcagaggcctgcatgcaagcttggcgtaatcatggtcatagct
gtttcctgtgtgaaattgttatccgctcacaattccacacaacatacgagccggaagcat
aaagtgtaaagcctggggtgcctaatgagtgagctaactcacattaattgcgttgcgctc
actgcccgctttccagtcgggaaacctgtcgtgccagctgcattaatgaatcggccaacg |

TABLE 24-continued

Additional Exemplary gene editing plasmids

| SEQ ID NO | Name | Sequence |
|---|---|---|
| | | cgcggggagaggcggtttgcgtattgggcgctcttccgcttcctcgctcactgactcgct<br>gcgctcggtcgttcggctgcggcgagcggtatcagctcactcaaaggcggtaatacggtt<br>atccacagaatcaggggataacgcaggaaagaacatgtgagcaaaaggccagcaaaaggc<br>caggaaccgtaaaaaggccgcgttgctggcgtttttccataggctccgcccccctgacga<br>gcatcacaaaaatcgacgctcaagtcagaggtggcgaaacccgacaggactataaagata<br>ccaggcgtttccccctggaagctccctcgtgcgctctcctgttccgaccctgccgctta<br>cggataccgtgccgcctttctcccttcgggaagcgtggcgctttctcatagctcacgctg<br>taggtatctcagttcggtgtaggtcgttcgctccaagctgggctgtgtgcacgaacccc<br>cgttcagcccgaccgctgcgccttatccggtaactatcgtcttgagtccaacccggtaag<br>acacgacttatcgccactggcagcagccactggtaacaggattagcagagcgaggtatgt<br>aggcggtgctacagagttcttgaagtggtggcctaactacggctacactagaagaacagt<br>atttggtatctgcgctctgctgaagccagttaccttcggaaaaagagttggtagctcttg<br>atccggcaaacaaaccaccgctggtagcggtggtttttttgtttgcaagcagcagattac<br>gcgcagaaaaaaaggatctcaagaagatcctttgatcttttctacggggtctgacgctca<br>gtggaacgaaaactcacgttaagggattttggtcatgagattatcaaaaaggatcttcac<br>ctagatccttttaaattaaaaatgaagttttaaatcaatctaaagtatatatgagtaaac<br>ttggtctgacagttaccaatgcttaatcagtgaggcacctatctcagcgatctgtctatt<br>tcgttcatccatagttgcctgactccccgtcgtgtagataactacgatacgggagggctt<br>accatctggccccagtgctgcaatgataccgcgagatccacgctcaccggctccagattt<br>atcagcaataaaccagccagccggaagggccgagcgcagaagtggtcctgcaactttatc<br>cgcctccatccagtctattaattgttgccgggaagctagagtaagtagttcgccagttaa<br>tagtttgcgcaacgttgttgccattgctacaggcatcgtggtgtcacgctcgtcgtttgg<br>tatggcttcattcagctccggttcccaacgatcaaggcgagttacatgatcccccatgtt<br>gtgcaaaaaagcggttagctccttcggtcctccgatcgttgtcagaagtaagttggccgc<br>agtgttatcactcatggttatggcagcactgcataattctcttactgtcatgccatccgt<br>aagatgcttttctgtgactggtgagtactcaaccaagtcattctgagaatagtgtatgcg<br>gcgaccgagttgctcttgcccggcgtcaatacgggataataccgcgccacatagcagaac<br>tttaaaagtgctcatcattggaaaacgttcttcggggcgaaaactctcaaggatcttacc<br>gctgttgagatccagttcgatgtaacccactcgtgcacccaactgatcttcagcatcttt<br>tactttcaccagcgtttctgggtgagcaaaaacaggaaggcaaaatgccgcaaaaaaggg<br>aataagggcgacacggaaatgttgaatactcatactcttcctttttcaatattattgaag<br>catttatcaggttattgtctcatgagcggatacatatttgaatgtatttagaaaaataa<br>acaaataggggttccgcgcacatttccccgaaaagtgccacctgacgtctaagaaaccat<br>tattatcatgacattaacctataaaaataggcgtatcacgaggccccttcgtc |
| 308 | pMGF-35S Hyg Annotated in pUC57 (pMGF) | tcgcgcgtttcggtgatgacggtgaaaacctctgacacatgcagctcccggagacggtca<br>cagcttgtctgtaagcggatgccgggagcagacaagcccgtcagggcgcgtcagcgggtg<br>ttggcgggtgtcggggctggcttaactatgcggcatcagagcagattgtactgagagtgc<br>accatatgcggtgtgaaataccgcacagatgcgtaaggagaaaataccgcatcaggcgcc<br>attcgccattcaggctgcgcaactgttgggaagggcgatcggtgcgggcctcttcgctat<br>tacgccagctggcgaaaggggatgtgctgcaaggcgattaagttgggtaacgccagggt<br>tttcccagtcacgacgttgtaaaacgacggccagtgaattcgagctcggtacctcgcgaa<br>tgcatctagataacaggtctcaactatgagacttttcaacaaagggtaatatcgggaaac<br>ctcctcggattccattgcccagctatctgtcacttcatcaaaaggacagtagaaaaggaa<br>ggtggcacctacaaatgccatcattgcgataaaggaaaggctatcgttcaagatgcctct<br>gccgacagtggtcccaaagatggaccccccaccacgaggagcatcgtggaaaaagaagac<br>gttccaaccacgtcttcaaagcaagtggattgatgtgatacatgtggagcacgacact<br>ctcgtctactccaagaatatcaaagatacagtctcagaagaccaaagggctattgagact<br>tttcaacaaagggtaatatcgggaaacctcctcggattccattgcccagctatctgtcac<br>ttcatcaaaaggacagtagaaaaggaaggtggcacctacaaatgccatcattgcgataaa<br>ggaaaggctatcgttcaagatgcctctgccgacagtggtcccaaagatggaccccccaccc<br>acgaggagcatcgtggaaaaagaagacgttccaaccacgtcttcaaagcaagtggattga<br>tgtgatatctccactgacgtaagggatgacgcacaatcccactatccttcgcaagacctt<br>cctctatataaggaagttcatttcatttggagaggacacgctgaaatcaccagtctctct<br>ctacaaatctatctctctcgagctttcgcagatcccggggggcaatgagatatgaaaaag<br>cctgaactcaccgcgacgtctgtcgagaagtttctgatcgaaaagttcgacagcgtctcc<br>gacctgatgcagctctcggagggcgaagaatctcgtgctttcagcttcgatgtaggaggg<br>cgtggatatgtcctgcgggtaaatagctgcgccgatggtttctacaaagatcgttatgtt<br>tatcggcactttgcatcggccgcgctcccgattccggaagtgcttgacattggggagttt<br>agcgagagcctgacctattgcatctcccgccgtgcacagggtgtcacgttgcaagacctg<br>cctgaaaccgaactgcccgctgttctacaaccggtcgcggaggctatggatgcgatcgct<br>gcggccgatcttagccagacgagcgggttcggcccattcggaccgcaaggaatcggtcaa<br>tacactacatggcgtgatttcatatgcgcgattgctgatccccatgtgtatcactggcaa<br>actgtgatggacgacaccgtcagtcgtccgtcgcgcaggctctcgatgagctgatgctt<br>tgggccgaggactgccccgaagtccggcacctcgtgcacgcggatttcggctccaacaat<br>gtcctgacggacaatggccgcataacagcggtcattgactggagcgaggcgatgttcggg<br>gattcccaatacgaggtcgccaacatcttcttctggaggccgtggttggcttgtatggag<br>cagcagacgcgctacttcgagcggaggcatccggagcttgcaggatcgccacgactccgg<br>gcgtatatgctccgcattggtcttgaccaactctatcagagcttggttgacggcaatttc<br>gatgatgcagcttgggcgcagggtcgatgcgacgcaatcgtccgatccggagccggact<br>gtcgggcgtacacaaatcgcccgcagaagcgcggccgtctggaccgatggctgtgtagaa<br>gtactcgccgatagtggaaaccgacgccccagcactcgtccgagggcaaagaaatagagt<br>agatgccgaccggatctgtcgatcgacaagctcgagtttctccataataatgtgtgagta<br>gttcccagataagggaattagggttcctatagggtttcgctcatgtgttgagcatataag<br>aaacccttagtatgtatttgtatttgtaaaatacttctatcaataaaatttctaattcct |

TABLE 24-continued

Additional Exemplary gene editing plasmids

| SEQ ID NO | Name | Sequence |
|---|---|---|
| | | aaaaccaaaatccagtactaaaatccagatcgtattgagacctgttatcggatcccgggc<br>ccgtcgactgcagaggcctgcatgcaagcttggcgtaatcatggtcatagctgtttcctg<br>tgtgaaattgttatccgctcacaattccacacaacatacgagccggaagcataaagtgta<br>aagcctggggtgcctaatgagtgagctaactcacattaattgcgttgcgctcactgcccg<br>ctttccagtcgggaaacctgtcgtgccagctgcattaatgaatcggccaacgcgcgggga<br>gaggcggtttgcgtattgggcgctcttccgcttcctcgctcactgactcgctgcgctcgg<br>tcgttcggctgcggcgagcggtatcagctcactcaaaggcggtaatacggttatccacag<br>aatcaggggataacgcaggaaagaacatgtgagcaaaaggccagcaaaaggccaggaacc<br>gtaaaaaggccgcgttgctggcgtttttccataggctccgcccccctgacgagcatcaca<br>aaaatcgacgctcaagtcagaggtggcgaaacccgacaggactataaagataccaggcgt<br>ttccccctggaagctccctcgtgcgctctcctgttccgaccctgccgcttaccggatacc<br>tgtccgcctttctcccttcgggaagcgtggcgctttctcatagctcacgctgtaggtatc<br>tcagttcggtgtaggtcgttcgctccaagctgggctgtgtgcacgaaccccccgttcagc<br>ccgaccgctgcgccttatccggtaactatcgtcttgagtccaacccggtaagacacgact<br>tatcgccactggcagcagccactggtaacaggattagcagagcgaggtatgtaggcggtg<br>ctacagagttcttgaagtggtggcctaactacggctacactagaagaacagtatttggta<br>tctgcgctctgctgaagccagttaccttcggaaaaagagttggtagctcttgatccggca<br>aacaaaccaccgctggtagcggtggtttttttgtttgcaagcagcagattacgcgcagaa<br>aaaaaggatctcaagaagatcctttgatcttttctacggggtctgacgctcagtggaacg<br>aaaactcacgttaaggggattttggtcatgagattatcaaaaaggatcttcacctagatc<br>cttttaaattaaaaatgaagttttaaatcaatctaaagtatatatgagtaaacttggtctg<br>acagttaccaatgcttaatcagtgaggcacctatctcagcgatctgtctatttcgttcat<br>ccatagttgcctgactccccgtcgtgtagataactacgatacgggagggcttaccatctg<br>gccccagtgctgcaatgataccgcgagatccacgctcaccggctccagatttatcagcaa<br>taaaccagccagccggaagggccgagcgcagaagtggtcctgcaactttatccgcctcca<br>tccagtctattaattgttgccgggaagctagagtaagtagttcgccagttaatagtttgc<br>gcaacgttgttgccattgctacaggcatcgtggtgtcacgctcgtcgtttggtatggctt<br>cattcagctccggttcccaacgatcaaggcgagttacatgatcccccatgttgtgcaaaa<br>aagcggttagctccttcggtcctccgatcgttgtcagaagtaagttggccgcagtgttat<br>cactcatggttatggcagcactgcataattctcttactgtcatgccatccgtaagatgct<br>tttctgtgactggtgagtactcaaccaagtcattctgagaatagtgtatgcggcgaccga<br>gttgctcttgcccggcgtcaatacgggataataccgcgccacatagcagaactttaaaag<br>tgctcatcattggaaaacgttcttcggggcgaaaactctcaaggatcttaccgctgttga<br>gatccagttcgatgtaacccactcgtgcacccaactgatcttcagcatcttttactttca<br>ccagcgtttctgggtgagcaaaaacaggaaggcaaaatgccgcaaaaaagggaataaggg<br>cgacacggaaatgttgaatactcatactcttcctttttcaatattattgaagcatttatc<br>agggttattgtctcatgagcggatacatatttgaatgtatttagaaaaataaacaaatag<br>gggttccgcgcacatttccccgaaaagtgccacctgacgtctaagaaaccattattatca<br>tgacattaacctataaaaataggcgtatcacgaggccctttcgtc |
| 309 | pMGA_1m Annotated in pUC57 (pMGA) | tcgcgcgtttcggtgatgacggtgaaaacctctgacacatgcagctcccggagacggtca<br>cagcttgtctgtaagcggatgccgggagcagacaagcccgtcagggcgcgtcagcgggtg<br>ttggcgggtgtcggggctggcttaactatgcggcatcagagcagattgtactgagagtgc<br>accatatgcggtgtgaaataccgcacagatgcgtaaggagaaaataccgcatcaggcgcc<br>attcgccattcaggctgcgcaactgttgggaagggcgatcggtgcgggcctcttcgctat<br>tacgccagctggcgaaaggggggatgtgctgcaaggcgattaagttgggtaacgccagggt<br>tttcccagtcacgacgttgtaaaacgacggccagtgaattcgagctcggtacctcgcgaa<br>tgcatctagataacaggtctcaacctcgatttcttagggccgtaggctagtaatcatcg<br>accgttttaatcattaatgtacttagacaataaatataagatgcaatacaagtcaatggg<br>agaaactagactttacaaaaccttaaaagccctggtgagatatgagaaggtttatgaca<br>gaatatatcgccattaatgtgaggtgtggacactgctggtagtcaaggctgcccgtgaa<br>ccatatttagtcacatgtaatcaccccgcgtgctaaacaaaaagcaaaatatcagtaaga<br>tagtcacagtcataacactgttgaatgggtcttcgccggatccagtgctaacatggtcta<br>gaaggaggtcagctatgcagtttaaggtttacacctataaagagaggccgttatcgtc<br>tgtttgtggatgtacagagtgatattattgacacgcccgggcgacggatggtgatccccc<br>tggccagtgcacgtctgctgtcagataaagtctcccgtgaactttaccagtggtgcata<br>tcggggatgaaagctggcgcatgatgaccaccgatatggccagtgtgccagtctccgtta<br>tcggggaagaagtggctgatctcagccaccgcgaaaatgacatcaaaaacgccattaacc<br>tgatgttctggggaatataactgcagaggaggtaatcaagaagacctgttttagagctag<br>aaaatagcaagttaaaataaggctagtccgttatcaacttgaaaaagtggcaccgagtcgg<br>tgcttttttatgccacaacactggtggtaccaacatgagacctgttatcggatcccggc<br>ccgtcgactgcagaggcctgcatgcaagcttggcgtaatcatggtcatagctgtttcctg<br>tgtgaaattgttatccgctcacaattccacacaacatacgagccggaagcataaagtgta<br>aagcctggggtgcctaatgagtgagctaactcacattaattgcgttgcgctcactgcccg<br>ctttccagtcgggaaacctgtcgtgccagctgcattaatgaatcggccaacgcgcgggga<br>gaggcggtttgcgtattgggcgctcttccgcttcctcgctcactgactcgctgcgctcgg<br>tcgttcggctgcggcgagcggtatcagctcactcaaaggcggtaatacggttatccacag<br>aatcaggggataacgcaggaaagaacatgtgagcaaaaggccagcaaaaggccaggaacc<br>gtaaaaaggccgcgttgctggcgtttttccataggctccgcccccctgacgagcatcaca<br>aaaatcgacgctcaagtcagaggtggcgaaacccgacaggactataaagataccaggcgt<br>ttccccctggaagctccctcgtgcgctctcctgttccgaccctgccgcttaccggatacc<br>tgtccgcctttctcccttcgggaagcgtggcgctttctcatagctcacgctgtaggtatc<br>tcagttcggtgtaggtcgttcgctccaagctgggctgtgtgcacgaaccccccgttcagc<br>ccgaccgctgcgccttatccggtaactatcgtcttgagtccaacccggtaagacacgact<br>tatcgccactggcagcagccactggtaacaggattagcagagcgaggtatgtaggcggtg |

TABLE 24-continued

Additional Exemplary gene editing plasmids

| SEQ ID NO | Name | Sequence |
|---|---|---|
| | | ctacagagttcttgaagtggtggcctaactacggctacactagaagaacagtatttggta tctgcgctctgctgaagccagttaccttcggaaaaagagttggtagctcttgatccggca aacaaaccaccgctggtagcggtggttttttgtttgcaagcagcagattacgcgcagaa aaaaaggatctcaagaagatcctttgatcttttctacggggtctgacgctcagtggaacg aaaactcacgttaagggattttggtcatgagattatcaaaaaggatcttcacctagatcc ttttaaattaaaaatgaagtttttaaatcaatctaaagtatatatgagtaaacttggtctg acagttaccaatgcttaatcagtgaggcacctatctcagcgatctgtctatttcgttcat ccatagttgcctgactccccgtcgtgtagataactacgatacgggagggcttaccatctg gccccagtgctgcaatgataccgcgagatccacgctcaccggctccagatttatcagcaa taaaccagccagccggaagggccgagcgcagaagtggtcctgcaactttatccgcctcca tccagtctattaattgttgccgggaagctagagtaagtagttcgccagttaatagtttgc gcaacgttgttgccattgctacaggcatcgtggtgtcacgctcgtcgtttggtatggctt cattcagctccggttcccaacgatcaaggcgagttacatgatcccccatgttgtgcaaaa aagcggttagctccttcggtcctccgatcgttgtcagaagtaagttggccgcagtgttat cactcatggttatggcagcactgcataattctcttactgtcatgccatccgtaagatgct tttctgtgactggtgagtactcaaccaagtcattctgagaatagtgtatgcggcgaccga gttgctcttgcccggcgtcaatacgggataataccgcgccacatagcagaactttaaaag tgctcatcattggaaaacgttcttcggggcgaaaactctcaaggatcttaccgctgttga gatccagttcgatgtaacccactcgtgcacccaactgatcttcagcatcttttactttca ccagcgtttctgggtgagcaaaaacaggaaggcaaaatgccgcaaaaaagggaataaggg cgacacggaaatgttgaatactcatactcttcctttttcaatattattgaagcatttatc agggttattgtctcatgagcggatacatatttgaatgtatttagaaaaataaacaaatag gggttccgcgcacatttccccgaaaagtgccacctgacgtctaagaaaccattattatca tgacattaacctataaaaataggcgtatcacgaggccctttcgtc |
| 310 | pMGA 2 Annotated in pUC57 (pMGA) | tcgcgcgtttcggtgatgacggtgaaaacctctgacacatgcagctcccggagacggtca cagcttgtctgtaagcggatgccgggagcagacaagcccgtcagggcgcgtcagcgggtg ttggcgggtgtcggggctggcttaactatgcggcatcagagcagattgtactgagagtgc accatatgcggtgtgaaataccgcacagatgcgtaaggagaaaataccgcatcaggcgc attcgccattcaggctgcgcaactgttgggaagggcgatcggtgcgggcctcttcgctat tacgccagctggcgaaaggggatgtgctgcaaggcgattaagttgggtaacgccagggt tttcccagtcacgacgttgtaaaacgacggccagtgaattcgagctcggtacctcgcgaa tgcatctagataacaggtctcaaccttgccaaaaagccttcttgtggcctgcttactatt aaggcaactaattcaagaacaagtgattctgggtaggtagatgccacagttcatgataat aaaggcgaagtcagaaggagtagtccgttgatgaagaaagcagaaggcaaggaatgttgg tggcttttggttgcggtagcactgaaaccgtgtccggacttcgccgggagcagacaatgg cttggttggattacataataataccccgcgggccagacaatattcaaaatcctaacaaag atgtctcaggtaatacattcgctaatgggtcttcgccggatccagtgctaacatggtcta gaaggaggtcagctatgcagtttaaggtttacacctataaaagagagagccgttatcgtc tgtttgtggatgtacagagtgatattattgacacgcccgggcgacggatggtgatccccc tggccagtgcacgtctgctgtcagataaagtctcccgtgaactttacccagtggtgcata tcggggatgaaagctggcgcatgatgaccaccgatatggccagtgtgccagtctccgtta tcggggaagaagtggctgatctcagccaccgcgaaaatgacatcaaaaacgccattaacc tgatgttctggggaatataactgcagaggaggtaatcaagaagacctgttttagagctag aaatagcaagttaaaataaggctagtccgttatcaacttgaaaaagtggcaccgagtcgg tgcttttttatgccacaacactggtggtaccaacatgagacctgttatcggatcccggc ccgtcgactgcagaggcctgcatgcaagcttggcgtaatcatggtcatagctgtttcctg tgtgaaattgttatccgctcacaattccacacaacatacgagccggaagcataaagtgta aagcctggggtgcctaatgagtgagctaactcacattaattgcgttgcgctcactgcccg ctttccagtcgggaaacctgtcgtgccagctgcattaatgaatcggccaacgcgcgggga gaggcggtttgcgtattgggcgctcttccgcttcctcgctcactgactcgctgcgctcgg tcgttcggctgcggcgagcggtatcagctcactcaaaggcggtaatacggttatccacag aatcaggggataacgcaggaaagaacatgtgagcaaaaggccagcaaaaggccaggaacc gtaaaaaggccgcgttgctggcgtttttccataggctccgcccccctgacgagcatcaca aaaatcgacgctcaagtcagaggtggcgaaacccgacaggactataaagataccaggcgt ttccccctggaagctccctcgtgcgctctcctgttccgaccctgccgcttaccggatacc tgtccgcctttctcccttcgggaagcgtggcgctttctcatagctcacgctgtaggtatc tcagttcggtgtaggtcgttcgctccaagctgggctgtgtgcacgaacccccccgttcagc ccgaccgctgcgccttatccggtaactatcgtcttgagtccaacccggtaagacacgact tatcgccactggcagcagccactggtaacaggattagcagagcgaggtatgtaggcggtg ctacagagttcttgaagtggtggcctaactacggctacactagaagaacagtatttggta tctgcgctctgctgaagccagttaccttcggaaaaagagttggtagctcttgatccggca aacaaaccaccgctggtagcggtggttttttgtttgcaagcagcagattacgcgcagaa aaaaaggatctcaagaagatcctttgatcttttctacggggtctgacgctcagtggaacg aaaactcacgttaagggattttggtcatgagattatcaaaaaggatcttcacctagatcc ttttaaattaaaaatgaagtttttaaatcaatctaaagtatatatgagtaaacttggtctg acagttaccaatgcttaatcagtgaggcacctatctcagcgatctgtctatttcgttcat ccatagttgcctgactccccgtcgtgtagataactacgatacgggagggcttaccatctg gccccagtgctgcaatgataccgcgagatccacgctcaccggctccagatttatcagcaa taaaccagccagccggaagggccgagcgcagaagtggtcctgcaactttatccgcctcca tccagtctattaattgttgccgggaagctagagtaagtagttcgccagttaatagtttgc gcaacgttgttgccattgctacaggcatcgtggtgtcacgctcgtcgtttggtatggctt cattcagctccggttcccaacgatcaaggcgagttacatgatcccccatgttgtgcaaaa aagcggttagctccttcggtcctccgatcgttgtcagaagtaagttggccgcagtgttat cactcatggttatggcagcactgcataattctcttactgtcatgccatccgtaagatgct |

TABLE 24-continued

Additional Exemplary gene editing plasmids

| SEQ ID NO | Name | Sequence |
|---|---|---|
| | | tttctgtgactggtgagtactcaaccaagtcattctgagaatagtgtatgcggcgaccga gttgctcttgcccggcgtcaatacgggataataccgcgccacatagcagaactttaaaag tgctcatcattggaaaacgttcttcggggcgaaaactctcaaggatcttaccgctgttga gatccagttcgatgtaacccactcgtgcacccaactgatcttcagcatcttttactttca ccagcgtttctgggtgagcaaaaacaggaaggcaaaatgccgcaaaaaagggaataaggg cgacacggaaatgttgaatactcatactcttccttttcaatattattgaagcatttatc agggttattgtctcatgagcggatacatatttgaatgtatttagaaaaataaacaaatag gggttccgcgcacatttccccgaaaagtgccacctgacgtctaagaaaccattattatca tgacattaacctataaaaataggcgtatcacgaggccctttcgtc |
| 311 | pMGA_11 Annotated in pUC57 (pMGA) | tcgcgcgtttcggtgatgacggtgaaaacctctgacacatgcagctcccggagacggtca cagcttgtctgtaagcggatgccgggagcagacaagcccgtcagggcgcgtcagcgggtg ttggcgggtgtcggggctggcttaactatgcggcatcagagcagattgtactgagagtgc accatatgcggtgtgaaataccgcacagatgcgtaaggagaaaataccgcatcaggcgcc attcgccattcaggctgcgcaactgttgggaagggcgatcggtgcgggcctcttcgctat tacgccagctggcgaaaggggatgtgctgcaaggcgattaagttgggtaacgccaggcgt tttcccagtcacgacgttgtaaaacgacggccagtgaattcgagctcggtacctcgcgaa tgcatctagataacaggtctcaacctggtaccagcagtaccagcaccagccactgcatta ttgaatctgacatctgcaacagcaaggtacaattttgttttacattttactcattaata ttagcacctatagctgtggccaatcttttgacgacgactctctcacgctggaggaaagca tggtacgggcattaattgccagcgtagaacaagcgtaggatatgggcaacctcgctgatt tctatatttggtaagaagtctcaccccgtgagctaagcaaaaagcaaaaccttgctatg tcaacatcccactgccatacactattgggtcttcgccggatccagtgctaacatggtcta gaaggaggtcagctatgcagtttaaggtttacacctataaaagagagagccgttatcgtc tgtttgtggatgtacagagtgatattattgacacgcccgggcgacggatggtgatccccc tggccagtgcacgtctgctgtcagataaagtctcccgtgaactttacccagtggtgcata tcggggatgaaagctggcgcatgatgaccaccgatatggccagtgtgccagtctccgtta tcggggaagaagtggctgatctcagccaccgcgaaaatgacatcaaaaacgccattaacc tgatgttctgggaatataactgcagaggaggtaatcaagaagacctgttttagagctag aaatagcaagttaaaataaggctagtccgttatcaacttgaaaaagtggcaccgagtcgg tgcttttttatgccacaacactggtggtaccaacatgagacctgttatcggatcccgggc ccgtcgactgcagaggcctgcatgcaagcttggcgtaatcatggtcatagctgtttcctg tgtgaaattgttatccgctcacaattccacacaacatacgagccggaagcataaagtgta aagcctggggtgcctaatgagtgagctaactcacattaattgcgttgcgctcactgcccg cttccagtcgggaaacctgtcgtgccagctgcattaatgaatcggccaacgcgcgggga gaggcggtttgcgtattgggcgctcttccgcttcctcgctcactgactcgctgcgctcgg tcgttcggctgcggcgagcggtatcagctcactcaaaggcggtaatacggttatccacag aatcaggggataacgcaggaaagaacatgtgagcaaaaggccagcaaaaggccaggaacc gtaaaaaggccgcgttgctggcgtttttccataggctccgcccccctgacgagcatcaca aaaatcgacgctcaagtcagaggtggcgaaacccgacaggactataaagataccaggcgt ttccccctggaagctccctcgtgcgctctcctgttccgaccctgccgcttaccggatac tgtccgcctttctcccttcgggaagcgtggcgctttctcatagctcacgctgtaggtatc tcagttcggtgtaggtcgttcgctccaagctgggctgtgtgcacgaaccccccgttcagc ccgaccgctgcgccttatccggtaactatcgtcttgagtccaacccggtaagacacgact tatcgccactggcagcagccactggtaacaggattagcagagcgaggtatgtaggcggtg ctacagagttcttgaagtggtggcctaactacggctacactagaagaacagtatttggta tctgcgctctgctgaagccagttaccttcggaaaaagagttggtagctcttgatccggca aacaaaccaccgctggtagcggtggtttttttgtttgcaagcagcagattacgcgcagaa aaaaaggatctcaagaagatcctttgatcttttctacggggtctgacgctcagtggaacg aaaactcacgttaagggattttggtcatgagattatcaaaaaggatcttcacctagatcc ttttaaattaaaaatgaagttttaaatcaatctaaagtatatatgagtaaacttggtctg acagttaccaatgcttaatcagtgaggcacctatctcagcgatctgtctatttcgttcat ccatagttgcctgactccccgtcgtgtagataactacgatacgggagggcttaccatctg gccccagtgctgcaatgataccgcgagatccacgctcaccggctccagatttatcagcaa taaaccagccagccggaagggccgagcgcagaagtggtcctgcaactttatccgcctcca tccagtctattaattgttgccgggaagctagagtaagtagttcgcagttaatagtttgc gcaacgttgttgccattgctacaggcatcgtggtgtcacgctcgtcgtttggtatggctt cattcagctccggttcccaacgatcaaggcgagttacatgatcccccatgttgtgcaaaa aagcggttagctccttcggtcctccgatcgttgtcagaagtaagttggccgcagtgttat cactcatggttatggcagcactgcataattctcttactgtcatgccatccgtaagatgct tttctgtgactggtgagtactcaaccaagtcattctgagaatagtgtatgcggcgaccga gttgctcttgcccggcgtcaatacgggataataccgcgccacatagcagaactttaaaag tgctcatcattggaaaacgttcttcggggcgaaaactctcaaggatcttaccgctgttga gatccagttcgatgtaacccactcgtgcacccaactgatcttcagcatcttttactttca ccagcgtttctgggtgagcaaaaacaggaaggcaaaatgccgcaaaaaagggaataaggg cgacacggaaatgttgaatactcatactcttccttttcaatattattgaagcatttatc agggttattgtctcatgagcggatacatatttgaatgtatttagaaaaataaacaaatag gggttccgcgcacatttccccgaaaagtgccacctgacgtctaagaaaccattattatca tgacattaacctataaaaataggcgtatcacgaggccctttcgtc |
| 312 | pMGB_1m Annotated in pUC57 (pMGB) | tcgcgcgtttcggtgatgacggtgaaaacctctgacacatgcagctcccggagacggtca cagcttgtctgtaagcggatgccgggagcagacaagcccgtcagggcgcgtcagcgggtg ttggcgggtgtcggggctggcttaactatgcggcatcagagcagattgtactgagagtgc accatatgcggtgtgaaataccgcacagatgcgtaaggagaaaataccgcatcaggcgcc attcgccattcaggctgcgcaactgttgggaagggcgatcggtgcgggcctcttcgctat |

TABLE 24-continued

Additional Exemplary gene editing plasmids

| SEQ ID NO | Name | Sequence |
|---|---|---|
| | | tacgccagctggcgaaaggggatgtgctgcaaggcgattaagttgggtaacgccagggt<br>tttcccagtcacgacgttgtaaaacgacggccagtgaattcgagctcggtacctcgcgaa<br>tgcatctagataacaggtctcaaacacgatttctttagggccgtaggctagtaatcatcg<br>accgttttaatcattaatgtacttagacaataaatataagatgcaatacaagtcaatggg<br>agaaactagactttacaaaacctttaaaagcccctggtgagatatgagaaggtttatgaca<br>gaatatatcgccattaatgtgaggttgtggacactgctggtagtcaaggctgcccgtgaa<br>ccatatttagtcacatgtaatcaccccgcgtgctaaacaaaaagcaaaatatcagtaaga<br>tagtcacagtcataacactgttgaatgggtcttcgccggatccagtgctaacatggtcta<br>gaaggaggtcagctatgcagtttaaggtttacacctataaaagagagagccgttatcgtc<br>tgtttgtggatgtacagagtgatattattgacacgcccgggcgacggatggtgatccccc<br>tggccagtgcacgtctgctgtcagataaagtctcccgtgaactttacccagtggtgcata<br>tcggggatgaaagctggcgcatgatgaccaccgatatggccagtgtgccagtctccgtta<br>tcggggaagaagtggctgatctcagccaccgcgaaaatgacatcaaaaacgccattaacc<br>tgatgttctggggaatataactgcagaggaggtaatcaagaagacctgttttagagctag<br>aaatagcaagttaaaataaggctagtccgttatcaacttgaaaaagtggcaccgagtcgg<br>tgcttttttatgccacaacactggtggtaccggcttgagacctgttatcggatcccgggc<br>ccgtcgactgcagaggcctgcatgcaagcttggcgtaatcatggtcatagctgtttcctg<br>tgtgaaattgttatccgctcacaattccacacaacatacgagccggaagcataaagtgta<br>aagcctggggtgcctaatgagtgagctaactcacattaattgcgttgcgctcactgcccg<br>ctttccagtcgggaaacctgtcgtgccagctgcattaatgaatcggccaacgcgcgggga<br>gaggcggtttgcgtattgggcgctcttccgcttcctcgctcactgactcgctgcgctcgg<br>tcgttcggctgcggcgagcggtatcagctcactcaaaggcggtaatacggttatccacag<br>aatcaggggataacgcaggaaagaacatgtgagcaaaaggccagcaaaaggccaggaacc<br>gtaaaaaggccgcgttgctggcgtttttccataggctccgcccccctgacgagcatcaca<br>aaaatcgacgctcaagtcagaggtggcgaaacccgacaggactataaagataccaggcgt<br>ttccccctggaagctccctcgtgcgctctcctgttccgaccctgccgcttaccggatacc<br>tgtccgcctttctcccttcgggaagcgtggcgctttctcatagctcacgctgtaggtatc<br>tcagttcggtgtaggtcgttcgctccaagctgggctgtgtgcacgaaccccccgttcagc<br>ccgaccgctgcgccttatccggtaactatcgtcttgagtccaacccggtaagacacgact<br>tatcgccactggcagcagccactggtaacaggattagcagagcgaggtatgtaggcggtg<br>ctacagagttcttgaagtggtggcctaactacggctacactagaagaacagtatttggta<br>tctgcgctctgctgaagccagttaccttcggaaaaagagttggtagctcttgatccggca<br>aacaaaccaccgctggtagcggtggtttttttgtttgcaagcagcagattacgcgcagaa<br>aaaaaggatctcaagaagatcctttgatcttttctacggggtctgacgctcagtggaacg<br>aaaactcacgttaagggattttggtcatgagattatcaaaaaggatcttcacctagatcc<br>ttttaaattaaaaatgaagttttaaatcaatctaaagtatatatgagtaaacttggtctg<br>acagttaccaatgcttaatcagtgaggcacctatctcagcgatctgtctatttcgttcat<br>ccatagttgcctgactccccgtcgtgtagataactacgatacgggagggcttaccatctg<br>gccccagtgctgcaatgataccgcgagatccacgctcaccggctccagatttatcagcaa<br>taaaccagccagccgaagggccgagcgcagaagtggtcctgcaactttatccgcctcca<br>tccagtctattaattgttgccgggaagctagagtaagtagttcgccagttaatagtttgc<br>gcaacgttgttgccattgctacaggcatcgtggtgtcacgctcgtcgtttggtatggctt<br>cattcagctccggttcccaacgatcaaggcgagttacatgatcccccatgttgtgcaaaa<br>aagcggttagctccttcggtcctccgatcgttgtcagaagtaagttggccgcagtgttat<br>cactcatggttatggcagcactgcataattctcttactgtcatgccatccgtaagatgct<br>tttctgtgactggtgagtactcaaccaagtcattctgagaatagtgtatgcggcgaccga<br>gttgctcttgcccggcgtcaatacgggataataccgcgccacatagcagaactttaaaag<br>tgctcatcattggaaaacgttcttcggggcgaaaactctcaaggatcttaccgctgttga<br>gatccagttcgatgtaacccactcgtgcacccaactgatcttcagcatcttttactttca<br>ccagcgtttctgggtgagcaaaaacaggaaggcaaaatgccgcaaaaaagggaataaggg<br>cgacacggaaatgttgaatactcatactcttcctttttcaatattattgaagcatttatc<br>agggttattgtctcatgagcggatacatatttgaatgtatttagaaaaataaacaaatag<br>gggttccgcgcacatttccccgaaaagtgccacctgacgtctaagaaaccattattatca<br>tgacattaacctataaaaataggcgtatcacgaggccctttcgtc |
| 313 | pMGB-2<br>Annotated<br>in pUC57<br>(pMGB) | tcgcgcgtttcggtgatgacggtgaaaacctctgacacatgcagctcccggagacggtca<br>cagcttgtctgtaagcggatgccgggagcagacaagcccgtcagggcgcgtcagcgggtg<br>ttggcgggtgtcggggctggcttaactatgcggcatcagagcagattgtactgagagtgc<br>accatatgcggtgtgaaataccgcacagatgcgtaaggagaaaataccgcatcaggcgcc<br>attcgccattcaggctgcgcaactgttgggaagggcgatcggtgcgggcctcttcgctat<br>tacgccagctggcgaaaggggatgtgctgcaaggcgattaagttgggtaacgccagggt<br>tttcccagtcacgacgttgtaaaacgacggccagtgaattcgagctcggtacctcgcgaa<br>tgcatctagataacaggtctcaaacatgccaaaaagccttcttgtggcctgcttactatt<br>aagcaactaattcaagaacaagtgattctgggtaggtagatgccacagttcatgataat<br>aaaggcgaagtcagaaggagtagtccgttgatgaagaaagcagaaggcaaggaatgttgg<br>tggcttttggttgcggtagcactgaaaccgtgtccggacttcgccgggagcagacaatgg<br>cttggttggattacataataataccccgcgggccagacaatattcaaaatcctaacaaag<br>atgtctcaggtaatacattcgctaatgggtcttcgccggatccagtgctaacatggtcta<br>gaaggaggtcagctatgcagtttaaggtttacacctataaaagagagagccgttatcgtc<br>tgtttgtggatgtacagagtgatattattgacacgcccgggcgacggatggtgatccccc<br>tggccagtgcacgtctgctgtcagataaagtctcccgtgaactttacccagtggtgcata<br>tcggggatgaaagctggcgcatgatgaccaccgatatggccagtgtgccagtctccgtta<br>tcggggaagaagtggctgatctcagccaccgcgaaaatgacatcaaaaacgccattaacc<br>tgatgttctggggaatataactgcagaggaggtaatcaagaagacctgttttagagctag<br>aaatagcaagttaaaataaggctagtccgttatcaacttgaaaaagtggcaccgagtcgg |

TABLE 24-continued

Additional Exemplary gene editing plasmids

| SEQ ID NO | Name | Sequence |
|---|---|---|
| | | tgcttttttatgccacaacactggtggtaccggcttgagacctgttatcggatcccgggc<br>ccgtcgactgcagaggcctgcatgcaagcttggcgtaatcatggtcatagctgtttcctg<br>tgtgaaattgttatccgctcacaattccacacaacatacgagccggaagcataaagtgta<br>aagcctggggtgcctaatgagtgagctaactcacattaattgcgttgcgctcactgcccg<br>ctttccagtcgggaaacctgtcgtgccagctgcattaatgaatcggccaacgcgcgggga<br>gaggcggtttgcgtattgggcgctcttccgcttcctcgctcactgactcgctgcgctcgg<br>tcgttcggctgcggcgagcggtatcagctcactcaaaggcggtaatacggttatccacag<br>aatcaggggataacgcaggaaagaacatgtgagcaaaaggccagcaaaaggccaggaacc<br>gtaaaaaggccgcgttgctggcgtttttccataggctccgcccccctgacgagcatcaca<br>aaaatcgacgctcaagtcagaggtggcgaaacccgacaggactataaagataccaggcgt<br>ttccccctggaagctccctcgtgcgctctcctgttccgaccctgccgcttaccggatacc<br>tgtccgcctttctcccttcgggaagcgtggcgctttctcatagctcacgctgtaggtatc<br>tcagttcggtgtaggtcgttcgctccaagctgggctgtgtgcacgaaccccccgttcagc<br>ccgaccgctgcgccttatccggtaactatcgtcttgagtccaacccggtaagacacgact<br>tatcgccactggcagcagccactggtaacaggattagcagagcgaggtatgtaggcggtg<br>ctacagagttcttgaagtggtggcctaactacggctacactagaagaacagtatttggta<br>tctgcgctctgctgaagccagttaccttcggaaaaagagttggtagctcttgatccggca<br>aacaaaccaccgctggtagcggtggtttttttgtttgcaagcagcagattacgcgcagaa<br>aaaaggatctcaagaagatcctttgatcttttctacggggtctgacgctcagtggaacg<br>aaaactcacgttaaggattttggtcatgagattatcaaaaaggatcttcacctagatc<br>ttttaaattaaaaatgaagttttaaatcaatctaaagtatatatgagtaaacttggtctg<br>acagttaccaatgcttaatcagtgaggcacctatctcagcgatctgtctatttcgttcat<br>ccatagttgcctgactccccgtgtgtagataactacgatacgggagggcttaccatctg<br>gccccagtgctgcaatgataccgcgagatcaacgctcaccggctccagatttatcagcaa<br>taaaccagccagccggaagggccgagcgcagaagtggtcctgcaactttatccgcctcca<br>tccagtctattaattgttgccgggaagctagagtaagtagttcgccagttaatagtttgc<br>gcaacgttgttgccattgctacaggcatcgtggtgtcacgctcgtcgtttggtatggctt<br>cattcagctccggttcccaacgatcaaggcgagttacatgatcccccatgttgtgcaaaa<br>aagcggttagctccttcggtcctccgatcgttgtcagaagtaagttggccgcagtgttat<br>cactcatggttatggcagcactgcataattctcttactgtcatgccatccgtaagatgct<br>tttctgtgactggtgagtactcaaccaagtcattctgagaatagtgtatgcggcgaccga<br>gttgctcttgcccggcgtcaatacgggataataccgcgccacatagcagaactttaaaag<br>tgctcatcattggaaaacgttcttcggggcgaaaactctcaaggatcttaccgctgttga<br>gatccagttcgatgtaacccactcgtgcacccaactgatcttcagcatcttttactttca<br>ccagcgtttctgggtgagcaaaaacaggaaggcaaaatgccgcaaaaaagggaataaggg<br>cgacacggaaatgttgaatactcatactcttcctttttcaatattattgaagcatttatc<br>agggttattgtctcatgagcggatacatatttgaatgtatttagaaaaataaacaaatag<br>gggttccgcgcacatttccccgaaaagtgccacctgacgtctaagaaaccattattatca<br>tgacattaacctataaaaataggcgtatcacgaggccctttcgtc |
| 601 | MG001_<br>AL056_<br>pGGZ003_<br>PsiP2g2_<br>PsiP2g3_<br>PsiP1g4_<br>PsiP1g3_<br>Cas9_<br>MGFHyg | cagttcgcgcttagctggataacgccacggaatgatgtcgtcgtgcacaacaatggtgac<br>ttctacagcgcggagaatctcgctctctccaggggaagccgaagtttccaaaaggtcgtt<br>gatcaaagctcgccgcgttgtttcatcaagccttacggtcaccgtaaccagcaaatcaat<br>atcactgtgtggcttcaggccgccatccactgcggagccgtacaaatgtacggccagcaa<br>cgtcggttcgagatggcgctcgatgacgccaactacctctgatagttgagtcgatacttc<br>ggcgatcaccgcttccctcataacacccctgtattactgtttatgtaagcagacagttt<br>tattgttcatgatgatatattttatcttgtgcaatgtaacatcagagattttgagacac<br>aacgtggctttgttgaataaatcgaacttttgctgagttgaaggatcagatcacgcatct<br>tcccgacaacgcagaccgttccgtggcaaagcaaaagttcaaaatcaccaactggtccac<br>ctacaacaaagctctcatcaaccgtggctccctcacttctggctggatgatgggcgat<br>tcaggcgatccccatccaacagcccgccgtcgagcgggctttttatccccggaagcctg<br>tggatagagggtagttatccacgtgaaaccgctaatgccccgcaaagccttgattcacgg<br>ggctttccggccgctccaaaaactatccacgtgaaatcgctaatcagggtacgtgaaat<br>cgctaatcggagtacgtgaaatcgctaataaggtcacgtgaaatcgctaatcaaaaagc<br>acgtgagaacgctaatagcccctttcagatcaacagcttgcaaacacccctcgctccggca<br>agtagttacagcaagtagtatgttcaattagcttttcaattatgaatatatatatcaatt<br>attggtcgcccttggcttgtggacaatgcgctacgcgcaccggctccgcccgtggacaac<br>cgcaagcggttgcccaccgtcgagcgcctttgcccacaacccggcggccggccgcaacag<br>atcgttttataaattttttttttttgaaaaagaaaaagcccgaaaggcggcaacctctcgg<br>gctctgatttccgatccccggaattagatcttggcaggatatattgtggtgtaacgtt<br>ggatctggctgagaacgccagctgtgcatgcttggtctagaatacGATCTGGATTTTA<br>GT<br>ACTGGATTTTGGTTTTAGGAATTAGAAATTTTATTGATAGA<br>AGTATTTTACAAATACAAA<br>TACATACTAAGGGTTTCTTATATGCTCAACACATGAGCGA<br>AACCCTATAGGAACCCTAAT<br>TCCCTTATCTGGGAACTACTCACACATTATTATGGAGAAA<br>CTCGAGCTTGTCGATCGACA<br>GATCCGGTCGGCATCTACTCTATTTCTTTGCCCTCGGACGA<br>GTGCTGGGGCGTCGGTTTC<br>CACTATCGGCGAGTACTTCTACACAGCCATCGGTCCAGAC<br>GGCCGCGCTTCTGCGGGCGA<br>TTTGTGTACGCCCGACAGTCCCGGCTCCGGATCGGACGAT<br>TGCGTCGCATCGACCCTGCG<br>CCCAAGCTGCATCATCGAAATTGCCGTCAACCAAGCTCTG |

TABLE 24-continued

Additional Exemplary gene editing plasmids

| SEQ ID NO Name | Sequence |
|---|---|
| | ATAGAGTTGGTCAAGACCAA<br>TGCGGAGCATATACGCCCGGAGTCGTGGCGATCCTGCAAG<br>CTCCGGATGCCTCCGCTCGA<br>AGTAGCGCGTCTGCTGCTCCATACAAGCCAACCACGGCCT<br>CCAGAAGAAGATGTTGGCGA<br>CCTCGTATTGGGAATCCCCGAACATCGCCTCGCTCCAGTC<br>AATGACCGCTGTTATGCGGC<br>CATTGTCCGTCAGGACATTGTTGGAGCCGAAATCCGCGTG<br>CACGAGGTGCCGGACTTCGG<br>GGCAGTCCTCGGCCCAAAGCATCAGCTCATCGAGAGCCTG<br>CGCGACGGACGCACTGACGG<br>TGTCGTCCATCACAGTTTGCCAGTGATACACATGGGGATC<br>AGCAATCGCGCATATGAAAT<br>CACGCCATGTAGTGTATTGACCGATTCCTTGCGGTCCGAA<br>TGGGCCGAACCCGCTCGTCT<br>GGCTAAGATCGGCCGCAGCGATCGCATCCATAGCCTCCGC<br>GACCGGTTGTAGAACAGCGG<br>GCAGTTCGGTTTCAGGCAGGTCTTGCAACGTGACACCCTG<br>TGCACGGCGGGAGATGCAAT<br>AGGTCAGGCTCTCGCTAAACTCCCCAATGTCAAGCACTTC<br>CGGAATCGGGAGCGCGGCCG<br>ATGCAAAGTGCCGATAAACATAACGATCTTTGTAGAAACC<br>ATCGGCGCAGCTATTTACCC<br>GCAGGACATATCCACGCCCTCCTACATCGAAGCTGAAAGC<br>ACGAGATTCTTCGCCCTCCG<br>AGAGCTGCATCAGGTCGGAGACGCTGTCGAACTTTTCGAT<br>CAGAAACTTCTCGACAGACG<br>TCGCGGTGAGTTCAGGCTTTTTCATATCTCATTGCCCCCCG<br>GGATCTGCGAAAGCTCGAG<br>AGAGATAGATTTGTAGAGAGAGACTGGTGATTTCAGCGTG<br>TCCTCTCCAAATGAAATGAA<br>CTTCCTTATATAGAGGAAGGTCTTGCGAAGGATAGTGGGA<br>TTGTGCGTCATCCCTTACGT<br>CAGTGGAGATATCACATCAATCCACTTGCTTTGAAGACGT<br>GGTTGGAACGTCTTCTTTTT<br>CCACGATGCTCCTCGTGGGTGGGGGTCCATCTTTGGGACC<br>ACTGTCGGCAGAGGCATCTT<br>GAACGATAGCCTTTCCTTTATCGCAATGATGGCATTTGTA<br>GGTGCCACCTTCCTTTTCTA<br>CTGTCCTTTTGATGAAGTGACAGATAGCTGGGCAATGGAA<br>TCCGAGGAGGTTTCCCGATA<br>TTACCCTTTGTTGAAAAGTCTCAATAGCCCTTTGGTCTTCT<br>GAGACTGTATCTTTGATAT<br>TCTTGGAGTAGACGAGAGTGTCGTGCTCCACCATGTTATC<br>ACATCAATCCACTTGCTTTG<br>AAGACGTGGTTGGAACGTCTTCTTTTTCCACGATGCTCCTC<br>GTGGGTGGGGGTCCATCTT<br>TGGGACCACTGTCGGCAGAGGCATCTTGAACGATAGCCTT<br>TCCTTTATCGCAATGATGGC<br>ATTTGTAGGTGCCACCTTCCTTTTCTACTGTCCTTTTGATG<br>AAGTGACAGATAGCTGGGC<br>AATGGAATCCGAGGAGGTTTCCCGATATTACCCTTTGTTG<br>AAAAGTCTCAtagtGATCTG<br>GATTTTAGTACTGGATTTTGGTTTTAGGAATTAGAAATTTT<br>ATTGATAGAAGTATTTTAC<br>AAATACAAATACATACTAAGGGTTTCTTATATGCTCAACA<br>CATGAGCGAAACCCTATAGG<br>AACCCTAATTCCCTTATCTGGGAACTACTCACACATTATTA<br>TGGAGAAACTCGAGCTTGT<br>CGATCGACAGATCCGGTCGGCATCTACTtcagacttttctttttttttttggt<br>gctgctg<br>ggactccatggattccatctcctcccaattgtgacaaatcgattcttgtttcatacaatc<br>ctgtgattgattgatggatcaatgttgcatccaagacttcttttgttgatgtatatctttt<br>ttctatcgattgttgtatcgaaatatttgaatgctgctggtgctcccaagtttgtcaatg<br>tgaacaaatggatgatgttttctgcttgttctctgattggtttatctctatgtttgttat<br>atgctgacaagacttatccaagtttgcatctgccaagatgactcttttgagaattctg<br>agatttgttcgatgatttcatccaaataatgtttatgttgttcgacgaacaattgttttt<br>gttcgttatcttctggtgatccttcaattttcataatgtgatgccaaatacaagaagt<br>tgacatattttgatggcaatgccaattcgtttccttttgcaattctcctgctgatgcca<br>acattcttttcttccgttttccaattcgaacaatgaatattttggcaatttgatgatca<br>aatctttttgacttctttatatccttttgcttccaagaaatcgattgggttttttttcga<br>atgatgatctttccatgattgtgattcccaacaattctttgactgatttcaatttttttg<br>attttcctttttcgacttttgcgacgaccaagactgaatatgcgactgttggtgaatcga<br>atcctccatatttttttggatcccaatcttttttttcttgcgatcaatttatctgagtttc<br>ttttttggcaagattgattcttttgagaatcctcctgtttggacttctgttttttttgacga |

TABLE 24-continued

Additional Exemplary gene editing plasmids

| SEQ ID NO | Name | Sequence |
|---|---|---|
| | | tgttgacttgtggcattgacaagacttttctgactgttgcgaaatctcttcctttatccc
agacgatttctcctgtttctccgtttgtttcgatcaatggtcttttctgatttctccgt
ttgccaatgtgatttctgttttgaagaagttcatgatgtttgaatagaagaaatattttg
ctgttgcttttccgatttcttgttctgattttgcgatcattttctgacatcatagactt
tataatctccatagacgaattctgattccaattttggatattttttgatcaatgctgttc
cgacgactgcgttcaaatatgcatcatgtgcatgatagttgttgatttctctgactt
tatagaattggaaatcttttctgaaatctgaaccaattttgatttcaatgtgatgactt
tgacttctctgatcaatttatcgttttcatcatattttgattgttcattcttgaatccaaga
tttgtgcgacatgttttgtgatttgtcttgtttcgaccaattgtcttttgatgaatcctg
ctttatccaattctgacaatcctcctctttctgcttttgtcaagttatcgaattttcttt
gtgtgatcaattttgcgttcaacaattgtctccaatagttttttcattttttttgacgactt
cttctgatgggacgttatctgattttcctctgttttatctgatctttgtcaagactttgt
tatcgattgaatcatctttcaagaatgattgtgggacgatatgatcgacatcataatctg
acaatctgttgatatccaattcttgatcgacatacatatctcttccgttttgcaaataat
acaaatacaattttcgtttgcaattgtgtgttttcgactggatgttctttcaagatttt
gtgatcccaattctttgattccttcttcgattcttttcattctttctcttgagtttttt
gtccttttgtgttgtttggttttctcttgccatttcgatgacgatgttttctggtttat
gtcttccatgactttgaccaattcatcgacgactttgactgtttgcaagattccttttt
tgattgctggtgatcctgccaagtttgcgatatgttcatgcaatgaatctccttgtcctg
agacttgtgcttttggatatcttcttgaatgtcaatgaatcatcatggatcaattgca
tgaagtttctgtttgcgaatccatctgatttcaagaaatccaagattgttttcctgatt
gtttatctctgattccgttgatcaattttcttgacaatcttcccatcctgtatatcttc
ttcttttcaattgtttcatgactttatcatcgaacaaatgtgcatatgttttcaatcttt
cttcgatcatttctctatcttcgaacaatgtcaatgtcaagacgatatcttccaagatat
cttcgttttcttcgttatccaagaaatctttatctttgatgattttcaacaaatcatgat
atgttcccaatgatgcgttgaatctatcttcgactcctgagatttcgactgaatcgaagc
attcgatttttttgaaataatcttctttcaattgtttgactgtgacttttctgtttgttt
tgaacaacaaatcgacgattgcttttttttgttctcctgacaagaatgctggttttctca
ttccttctgtgacatatttgacttttgtcaattcgttatagactgtgaaatattcataca
acaatgaatgttttggcaagacttttcgtttggcaagttttatcgaagtttgtcattc
tttcgatgaatgattgtgctgatgctcctttatcgacgacttcttcgaagttccatggtg
tgattgtttcttctgattttcttgtcatccatgcgaatcttgagtttcctcttgccaatg
gtccgacataatatgggattctgaatgtcaagattttttcgattttttctctgttatctt
tcaagaatggatagaaatcttcttgtcttctcaagattgcatgcaattctcccaaatgga
tttgatgtgggattgatccgttatcgaatgttctttgttttctcaacaaatcttctctgt
tcaatttgaccaacaattcttctgttccatccattttttccaagattggtttgatgaatt
tatagaattcttcttgtgatgctcctccatcgatatatcctgcatatccgttttttgtt
gatcgaagaagatttctttatattttctggcaattgttgtctgaccaatgctttcaaca
atgtcaaatcttgatgatgttcatcatatcttttgatcattgatgctgacaatggtgctt
ttgtgatttctgtgttgactctcaagatatctgacaacaagattgcatctgacaagtttt
ttgctgccaagaacaaatctgcatattgatctccgatttgtgccaacaagttatccaaat
catcatcatatgtatctttgacaattgcaattttgcatcttctgccaaatcgaagtttg
atttgaagtttggtgtcaatcccaatgacaatgcgatcaagtttccgaacaatccgtttt
ttttttctcctggcaattgtgcgatcaagttttccaatcttcttgattttgacaatcttg
ctgacaagattgcttttgcatcgactcctgatgcgttgattgggttttcttcgaacaatt
ggttatatgtttggaccaattggatgaacaatttatcgacatctgagttatctgggttca
aatctccttcgatcaagaaatgtcctctgaatttgatcatatgtgccaatgccaaataga
tcaatctcaaatctgctttatctgttgaatcgaccaatttttttctcaaatgatagattg
ttggatattttcatgatatgcgacttcatcgacgatgtttccgaagattggatgtcttt
catgttttttatcttcttcgaccaagaatgattcttccaatctatggaagaatgaatcat
cgacttttgccatttcgtttgagaagatttcttgcaaatagcagattctgttttttcttc
ttgtatatcttcttcttgctgttcttttcaatcttgttgcttctgctgtttctcctgaat
cgaacaacaatgctccgatcaagttttttttgattgaatgtctatctgtgtttcccaaga
ctttgaatttttttgatgggactttatattcatctgtgatgactgcccatccgactgagt
ttgttccgatatccaatccgattgaatattttttatctgctgctgggactccatggattc
cgacttttcttttttttttggtgctgctttatcatcatcattttataatcgatatcat
gatctttataatctccatcatgatctttataatcTTTAACCTACAAGTCGACATC
AGTGA
GCTGCTGGGTGGTATGCAAGCGAGAGACAAACCATggtaccG
GCGATGAGCTTGTTGTGT
GTAGATGGGAGAAAACGGAGATGGTGGATGTGACCGGAA
TTGGGGTTTTTGTACTATCGA
TGTCATCACAAATTATTATCATATCAGATTGCTAACCCCTA
AACACCGAGAACATTCGAG
ACGCGGGAACAGCAGCTCTAGATCCTCAACGCTTATAAAC
TGCTAGCCTGACACAGAATG
ACGCAAGCCTCGAAAATGCTCTATTGTTAAAAACGTACTG
AACTTTCAATCTACTTGCGG
ACCTCTTAATTCTTCTTCGCTACATACACAACCTCATCGCA
GACTCTACGCGCATATCCC
CACTCATTATCATACCATGCAACTAATTTCATAAAACGCG
AGTTCAACGCGATGCCCGCT
TTTGCGTCAAAGATCATCGAATAGTTGCTCCCAACGAAAT
CGGTGGAAACAACGTCTTCT
TCCGTATAGTCGACAATGCCTTTCTCGATGCCCGGGTGTTT |

TABLE 24-continued

Additional Exemplary gene editing plasmids

| SEQ ID NO Name | Sequence |
| --- | --- |
| | ACCGTCGGCTGCGTCTTTC<br>AGAGCTCgcagggtaccaccagtgttgtggcatAAAAAAGCACCGACTC<br>GGTGCCACTTT<br>TTCAAGTTGATAACGGACTAGCCTTATTTTAACTTGCTATT<br>TCTAGCTCTAaaacCCGAA<br>GGTAAATCGCGAGTCCAATAGTGTATGGCAGTGGGATGTT<br>GACATAGCAAGGGTTTTGCT<br>TTTTGCTTAGCTCACGGGGTGAGACTTCTTACCAAATATA<br>GAAATCAGCGAGGTTGCCCA<br>TATCCTACGCTTGTTCTACGCTGGCAATTAATGCCCGTACC<br>ATGCTTTCCTCCAGCGTGA<br>GAGAGTCGTCGTCAAAAGATTGGCCACAGCTATAGGTGCT<br>AATATTAATGAGTAAAATGT<br>AAAACAAAATTGTACCTTGCTGTTGCAGATGTCAGATTC<br>AATAATGCAGTGGCTGGTGC<br>TGGTACTGCTGGTACCctgaggtaccaccagtgttgtggcatAAAAAAGC<br>ACCGACTCGG<br>TGCCACTTTTTCAAGTTGATAACGGACTAGCCTTATTTTAA<br>CTTGCTATTTCTAGCTCTA<br>aaacCCATGGTGCGCGTTACCCCACAATAGTGTATGGCAGT<br>GGGATGTTGACATAGCAAG<br>GGTTTTGCTTTTTGCTTAGCTCACGGGGTGAGACTTCTTAC<br>CAAATATAGAAATCAGCGA<br>GGTTGCCCATATCCTACGCTTGTTCTACGCTGGCAATTAAT<br>GCCCGTACCATGCTTTCCT<br>CCAGCGTGAGAGAGTCGTCGTCAAAAGATTGGCCACAGCT<br>ATAGGTGCTAATATTAATGA<br>GTAAAATGTAAAACAAAATTGTACCTTGCTGTTGCAGAT<br>GTCAGATTCAATAATGCAGT<br>GGCTGGTGCTGGTACTGCTGGTACCagccggtaccaccagtgttgtggc<br>atAAAAAAGCA<br>CCGACTCGGTGCCACTTTTTCAAGTTGATAACGGACTAGC<br>CTTATTTTAACTTGCTATTT<br>CTAGCTCTAaaacTTGCGGTATAACCGGAGATGCATTAGCG<br>AATGTATTACCTGAGACAT<br>CTTTGTTAGGATTTTGAATATTGTCTGGCCCGCGGGGTATT<br>ATTATGTAATCCAACCAAG<br>CCATTGTCTGCTCCCGGCGAAGTCCGGACACGGTTTCAGT<br>GCTACCGCAACCAAAAGCCA<br>CCAACATTCCTTGCCTTCTGCTTTCTTCATCAACGGACTAC<br>TCCTTCTGACTTCGCCTTT<br>ATTATCATGAACTGTGGCATCTACCTACCCAGAATCACTT<br>GTTCTTGAATTAGTTGCCTT<br>AATAGTAAGCAGGCCACAAGAAGGCTTTTTGGCAtgttggtacc<br>accagtgttgtggcat<br>AAAAAAGCACCGACTCGGTGCCACTTTTTCAAGTTGATAA<br>CGGACTAGCCTTATTTTAAC<br>TTGCTATTTCTAGCTCTAaaacTCATGGAGCCAGATATCCAA<br>CATTAGCGAATGTATTAC<br>CTGAGACATCTTTGTTAGGATTTTGAATATTGTCTGGCCCG<br>CGGGGTATTATTATGTAAT<br>CCAACCAAGCCATTGTCTGCTCCCGGCGAAGTCCGGACAC<br>GGTTTCAGTGCTACCGCAAC<br>CAAAAGCCACCAACATTCCTTGCCTTCTGCTTTCTTCATCA<br>ACGGACTACTCCTTCTGAC<br>TTCGCCTTTATTATCATGAACTGTGGCATCTACCTACCCAG<br>AATCACTTGTTCTTGAATT<br>AGTTGCCTTAATAGTAAGCAGGCCACAAGAAGGCTTTTTG<br>GCAaggtggtacctggtgcg<br>atcgctgttggcgcgccgtgtttaattaaggttgcggccgcttacttcgtccgagcctag<br>ttcgagccttgacaggatatattggcgggtaaactaagtcgctgtatgtgtttgtttgag<br>atctcatgtgagcaaaaggccagcaaaaggccaggaaccgtaaaaaggccgcgttgctgg<br>cgttttttccataggctccgcccccctgacgagcatcacaaaaatcgacgctcaagtcaga<br>ggtggcgaaacccgacaggactataaagataccaggcgtttccccctggaagctccctcg<br>tgcgctctcctgttccgaccctgccgcttaccggatacctgtccgcctttctcccttcgg<br>gaagcgtggcgctttctcatagctcacgctgtaggtatctcagttcggtgtaggtcgttc<br>gctccaagctgggctgtgtgcacgaaccccccgttcagcccgaccgctgcgccttatccg<br>gtaactatcgtcttgagtccaacccggtaagacacgacttatcgccactggcagcagcca<br>ctggtaacaggattagcagagcgaggtatgtaggcggtgctacagagttcttgaagtggt<br>ggcctaactacggctacactagaagaacagtatttggtatctgcgctctgctgaagccag<br>ttaccttcggaagaagagttggtagctcttgatccggcaaacaaaccaccgctggtagcg<br>gtggtttttttgtttgcaagcagcagattacgcgcagaaaaaaaggatctcaagaagatc<br>ctttgatcttttctacggggtctgacgctcagtggaacgaaaactcacgttaagggattt<br>tggtcatgagattatcaaaaaggatcttcacctagatccttttaaattaaaaatgaagtt<br>ttaaatcaatctaaagtatatatgtgtaacattggtctagtgattatttgccgactacct |

TABLE 24-continued

Additional Exemplary gene editing plasmids

| SEQ ID NO | Name | Sequence |
|---|---|---|
|  |  | tggtgatctcgcctttcacgtagtgaacaaattcttccaactgatctgcgcgcgaggcca agcgatcttcttgtccaagataagcctgcctagcttcaagtatgacgggctgatactggg ccggcaggcgctccattgcccagtcggcagcgacatccttcggcgcgattttgccggtta ctgcgctgtaccaaatgcgggacaacgtaagcactacatttcgctcatcgccagcccagt cgggcggcgagttccatagcgttaaggtttcatttagcgcctcaaatagatcctgttcag gaaccggatcaaagagttcctccgccgctggacctaccaaggcaacgctatgttctcttg cttttgtcagcaagatagccagatcaatgtcgatcgtggctggctcgaagatacctgcaa gaatgtcattgcgctgccattctccaaattg |
| 602 | MG002_AL056_pGGZ003_PsiP2g2_PsiP2g3_PsiP1g1_PsiP1g2_Cas9_MGFHyg | cagttcgcgcttagctggataacgccacggaatgatgtcgtcgtgcacaacaatggtgac ttctacagcgcggagaatctcgctctctccaggggaagccgaagtttccaaaaggtcgtt gatcaaagctcgccgcgttgtttcatcaagccttacggtcaccgtaaccagcaaatcaat atcactgtgtggcttcaggccgccatccactgcggagccgtacaaatgtacggccagcaa cgtcggttcgagatggcgctcgatgacgccaactacctctgatagttgagtcgatacttc ggcgatcaccgcttccctcataacaccccttgtattactgtttatgtaagcagacagttt tattgttcatgatgatatattttttatcttgtgcaatgtaacatcagagattttgagacac aacgtggctttgttgaataaaatcgaacttttgctgagttgaaggatcagatcacgcatct tcccgacaacgcagaccgttccgtggcaaagcaaaagttcaaaatcaccaactggtccac ctacaacaaagctctcatcaaccgtggctccctcactttctggctggatgatgggcgat tcaggcgatccccatccaacagcccgccgtcgagcgggcttttttatcccccggaagcctg tggatagaggggtagttatccacgtgaaaccgctaatgccccgcaaagccttgattcacgg ggctttccggcccgctccaaaaactatccacgtgaaatcgctaatcagggtacgtgaaat cgctaatcggagtacgtgaaatcgctaataaggtcacgtgaaatcgctaatcaaaaaggc acgtgagaacgctaatagcccctttcagatcaacagcttgcaaacacccctcgctccggca agtagttacagcaagtagtatgttcaattagcttttcaattatgaatatatatatcaatt attggtcgcccttggcttgtggacaatgcgctacgcgcaccggctccgcccgtggacaac cgcaagcggttgcccaccgtcgagcgcctttgcccacaacccggcggccggccgcaacag atcgttttataaattttttttttgaaaagaaaaagcccgaaaggcggcaacctctcgg gcttctggatttccgatccccgaattagatcttggcaggatatattgtggtgtaacgtt ggatctggctgagaacgccagctgtgcatgcttggtctagaatacGATCTGGATTTTA GT<br>ACTGGATTTTGGTTTTAGGAATTAGAAATTTTATTGATAGA AGTATTTTACAAATACAAA TACATACTAAGGGTTTCTTATATGCTCAACACATGAGCGA AACCCTATAGGAACCCTAAT TCCCTTATCTGGGAACTACTCACACATTATTATGGAGAAA CTCGAGCTTGTCGATCGACA GATCCGGTCGGCATCTACTCTATTTCTTTGCCCTCGGACGA GTGCTGGGCGTCGGTTTC CACTATCGGCGAGTACTTCTACACAGCCATCGGTCCAGAC GGCCGCGCTTCTGCGGGCGA TTTGTGTACGCCCGACAGTCCCGGCTCCGGATCGGACGAT TGCGTCGCATCGACCCTGCG CCCAAGCTGCATCATCGAAATTGCCGTCAACCAAGCTCTG ATAGAGTTGGTCAAGACCAA TGCGGAGCATATACGCCCGGAGTCGTGGCGATCCTGCAAG CTCCGGATGCCTCCGCTCGA AGTAGCGCGTCTGCTGCTCCATACAAGCCAACCACGGCCT CCAGAAGAAGATGTTGGCGA CCTCGTATTGGGAATCCCCGAACATCGCCTCGCTCCAGTC AATGACCGCTGTTATGCGGC CATTGTCCGTCAGGACATTGTTGGAGCCGAAATCCGCGTG CACGAGGTGCCGGACTTCGG GGCAGTCCTCGGCCCAAAGCATCAGCTCATCGAGAGCCTG CGCGACGGACGCACTGACGG TGTCGTCCATCACAGTTTGCCAGTGATACACATGGGGATC AGCAATCGCGCATATGAAAT CACGCCATGTAGTGTATTGACCGATTCCTTGCGGTCCGAA TGGGCCGAACCCGCTCGTCT GGCTAAGATCGGCCGCAGCGATCGCATCCATAGCCTCCGC GACCGGTTGTAGAACAGCGG GCAGTTCGGTTTCAGGCAGGTCTTGCAACGTGACACCCTG TGCACGGCGGGAGATGCAAT AGGTCAGGCTCTCGCTAAACTCCCCAATGTCAAGCACTTC CGGAATCGGGAGCGCGGCCG ATGCAAAGTGCCGATAAACATAACGATCTTTGTAGAAACC ATCGGCGCAGCTATTTACCC GCAGGACATATCCACGCCCTCCTACATCGAAGCTGAAAGC ACGAGATTCTTCGCCCTCCG AGAGCTGCATCAGGTCGGAGGACGCTGTCGAACTTTTCGAT CAGAAACTTCTCGACAGACG TCGCGGTGAGTTCAGGCTTTTTCATATCTCATTGCCCCCG GGATCTGCGAAAGCTCGAG AGAGATAGATTTGTAGAGAGAGACTGGTGATTTCAGCGTG TCCTCTCCAAATGAAATGAA |

TABLE 24-continued

Additional Exemplary gene editing plasmids

| SEQ ID NO | Name | Sequence |
|---|---|---|
| | | CTTCCTTATATAGAGGAAGGTCTTGCGAAGGATAGTGGGA
TTGTGCGTCATCCCTTACGT
CAGTGGAGATATCACATCAATCCACTTGCTTTGAAGACGT
GGTTGGAACGTCTTCTTTTT
CCACGATGCTCCTCGTGGGTGGGGGTCCATCTTTGGGACC
ACTGTCGGCAGAGGCATCTT
GAACGATAGCCTTTCCTTTATCGCAATGATGGCATTTGTA
GGTGCCACCTTCCTTTTCTA
CTGTCCTTTTGATGAAGTGACAGATAGCTGGGCAATGGAA
TCCGAGGAGGTTTCCCGATA
TTACCCTTTGTTGAAAAGTCTCAATAGCCCTTTGGTCTTCT
GAGACTGTATCTTTGATAT
TCTTGGAGTAGACGAGAGTGTCGTGCTCCACCATGTTATC
ACATCAATCCACTTGCTTTG
AAGACGTGGTTGGAACGTCTTCTTTTTCCACGATGCTCCTC
GTGGGTGGGGGTCCATCTT
TGGGACCACTGTCGGCAGAGGCATCTTGAACGATAGCCTT
TCCTTTATCGCAATGATGGC
ATTTGTAGGTGCCACCTTCCTTTTCTACTGTCCTTTTGATG
AAGTGACAGATAGCTGGGC
AATGGAATCCGAGGAGGTTTCCCGATATTACCCTTTGTTG
AAAAGTCTCAtagtGATCTG
GATTTTAGTACTGGATTTTGGTTTTAGGAATTAGAAATTTT
ATTGATAGAAGTATTTTAC
AAATACAAATACATACTAAGGGTTTCTTATATGCTCAACA
CATGAGCGAAACCCTATAGG
AACCCTAATTCCCTTATCTGGGAACTACTCACACATTATTA
TGGAGAAACTCGAGCTTGT
CGATCGACAGATCCGGTCGGCATCTACTtcagactttctttttttttttggt
gctgctg
ggactccatggattccatctcctcccaattgtgacaaatcgattcttgtttcatacaatc
ctgtgattgattgatggatcaatgttgcatccaagacttcttttgttgatgtatatcttt
ttctatcgattgttgtatcgaaatatttgaatgctgctggtgctcccaagtttgtcaatg
tgaacaaatggatgatgttttctgcttgttctctgattggtttatctctatgtttgttat
atgctgacaagactttatccaagttgcatctgccaagatgactcttttgagaattctg
agatttgttcgatgatttcatccaaataatgtttatgttgttcgacgaacaattgttttt
gttcgttatcttctggtgatcctttcaattttcataatgtgatgccaaatacaagaagt
tgacatattttgatggcaatgccaattcgtttccttttgcaattctcctgctgatgcca
acattctttttcttccgttttccaattcgaacaatgaatattttggcaatttgatgatca
aatcttttttgacttcttatatcctttgcttccaagaaatcgattgggttttttcga
atgatgatctttccatgattgtgattcccaacaattctttgactgatttcaattttttg
attttccttttcgactttttgcgacgaccaagactgaatatgcgactgttggtgaatcga
atcctccatattttttttggatcccaatctttttttcttgcgatcaatttatctgagttc
ttttttggcaagattgattcttttgagaatcctcctgtttggacttctgttttttgacga
tgttgacttgtgtggcattgacaagacttttctgactgttgcgaaatctcttccttatccc
agacgatttctcctgtttctccgtttgtttcgatcaatggtcttttctgatttctccgt
ttgccaatgtgatttctgttttgaagaagttcatgatgtttgaatagaagaaatattttg
ctgttgcttttccgatttcttgttctgattttgcgatcattttctgacatcatagactt
tataatctccatagacgaattctgattccaattttggatttttttgatcaatgctgttc
cgacgactgcgttcaaatatgcatcatgtgcatgatgatagttgttgatttctctgactt
tatagaattggaaatcttttctgaaatctgaaaccaatttgatttcaatgtgatgactt
tgacttctctgatcaatttatcgttttcatcatattttgtgttcattcttgaatccaaga
tttgtgcgacatgttttgtgatttgtcttgtttcgaccaattgtcttttgatgaatcctg
ctttatccaattctgacaatcctcctcttttctgcttttgtcaagttatcgaattttcttt
gtgtgatcaattttgcgttcaacaattgtctccaatagttttcatttttttgacgactt
cttctgatgggacgttatctgatttcctctgtttttatctgatcttgtcaagactttgt
tatcgattgaatcatctttcaagaatgattgtgggacgatatgatcgacatcataatctg
acaatctgttgatatccaattcttgatcgacatacatatctcttccgttttgcaaataat
acaaatacaattttcgttttgcaattgtgtgttttcgactggatgttctttcaagatttt
gtgatcccaattctttgattccttcttcgattcttttcattctttctcttgagttttttt
gtccttttgtgttgtttggtttctcttgccatttcgatgacgatgttttctggtttat
gtcttcccatgactttgaccaattcatcgacgactttgactgtttgcaagattccttttt
tgattgctggtgatcctgccaagtttgcgatatgttcatgcaatgaatctccttgtcctg
agacttgtgctttttggatatcttctttgaatgtcaatgaatcatcatggatcaattgca
tgaagtttctgtttgcgaatccatctgatttcaagaaatccaagattgttttcctgatt
gtttatctctgattccgttgatcaattttcttgacaatcttcccatcctgtatatcttc
ttcttttcaattgtttcatgactttatcatcgaacaaatgtgcatatgttttcaatcttt
cttcgatcatttctctatcttcgaacaatgtcaatgtcaagacgatatcttccaagatat
cttcgttttcttcgttatccaagaaatctttatctttgatgattttcaacaaatcatgat
atgttcccaatgatgcgttgaatctatcttcgactcctgagatttcgactgaatcgaagc
attcgattttttttgaaaataatcttctttcaattgtttgactgtgacttttctgtttgttt
tgaacaacaaatcgacgattgcttttttttgttctcctgacaagaatgctggttttctca
ttccttctgtgacatatttgacttttgtcaattcgttatagactgtgaaatattcataca
acaatgaatgttttggcaagacttttcgtttggcaagttttatcgaagtttgtcattc
tttcgatgaatgattgtgctgatgctcctttatcgacgacttcttcgaagttccatggtg |

TABLE 24-continued

Additional Exemplary gene editing plasmids

| SEQ ID NO Name | Sequence |
|---|---|
| | tgattgtttcttctgattttcttgtcatccatgcgaatcttgagtttcctcttgccaatg
gtccgacataatatgggattctgaatgtcaagattttttcgattttttctctgttatctt
tcaagaatggatagaaatcttcttgtcttctcaagattgcatgcaattctcccaaatgga
tttgatgtgggattgatccgttatcgaatgttctttgttttctcaacaaatcttctctgt
tcaatttgaccaacaattcttctgttccatccatttttttccaagattggtttgatgaatt
tatagaattcttcttgtgatgctcctccatcgatatatcctgcatatccgttttttgatt
gatcgaagaagatttctttatattttttctggcaattgttgtctgaccaatgctttcaaca
atgtcaaatcttgatgatgttcatcatatcttttgatcattgatgctgacaatggtgctt
ttgtgatttctgtgttgactctcaagatatctgacaacaagattgcatctgacaagtttt
ttgctgccaagaacaaatctgcatattgatctccgatttgtgccaacaagttatccaaat
catcatcatatgtatcttttgacaattgcaattttgcatcttctgccaaatcgaagtttg
atttgaagtttggtgtcaatcccaatgacaatgcgatcaagtttccgaacaatccgtttt
ttttttctcctggcaattgtgcgatcaagttttccaatcttcttgattttgacaatcttg
ctgacaagattgcttttgcatcgactcctgatgcgttgattgggttttcttcgaacaatt
ggttatatgtttggaccaattggatgaacaatttatcgacatctgagttatctgggttca
aatctccttcgatcaagaaatgtcctctgaatttgatcatatgtgccaatgccaaataga
tcaatctcaaatctgctttatctgttgaatcgaccaattttttttctcaaatgatagattg
ttggatattttttcatgatatgcgacttcatcgacgatgtttccgaagattggatgtcttt
catgttttttatcttcttcgaccaagaatgattcttccaatctatggaagaatgaatcat
cgacttttgccatttcgtttgagaagatttcttgcaaatagcagattctgttttttcttc
ttgtatatcttcttcttgctgttcttttcaatcttgttgcttctgctgtttctcctgaat
cgaacaacaatgctccgatcaagtttttttgattgaatgtctatctgtgttcccaaga
ctttgaatttttttgatgggactttatattcatctgtgatgactgcccatccgactgagt
ttgttccgatatccaatccgattgaatatttttatctgctgctgggactccatggattc
cgactttctttttttttggtgctgctttatcatcatcatcttataatcgatatcat
gatctttataatctccatcatgatctttataatcTTTAACCTACAAGTCGACATC
AGTGA
GCTGCTGGGTGGTATGCAAGCGAGAGACAAACCATggtaccG
GCGATGAGCTTGTTGTGT
GTAGATGGGAGAAAACGGAGATGGTGGATGTGACCGGAA
TTGGGGTTTTTGTACTATCGA
TGTCATCACAAATTATTATCATATCAGATTGCTAACCCCTA
AACACCGAGAACATTCGAG
ACGCGGGAACAGCAGCTCTAGATCCTCAACGCTTATAAAC
TGCTAGCCTGACACAGAATG
ACGCAAGCCTCGAAAATGCTCTATTGTTAAAAACGTACTG
AACTTTCAATCTACTTGCGG
ACCTCTTAATTCTTCTTCGCTACATACACAACCTCATCGCA
GACTCTACGCGCATATCCC
CACTCATTATCATACCATGCAACTAATTTCATAAAACGCG
AGTTCAACGCGATGCCCGCT
TTTGCGTCAAAGATCATCGAATAGTTGCTCCCAACGAAAT
CGGTGGAAACAACGTCTTCT
TCCGTATAGTCGACAATGCCTTTCTCGATGCCCGGGTGTTT
ACCGTCGGCTGCGTCTTTC
AGAGCTCgcagggtaccaccagtgttgtggcatAAAAAAGCACCGACTC
GGTGCCACTTT
TTCAAGTTGATAACGGACTAGCCTTATTTTAACTTGCTATT
TCTAGCTCTAaaacCACTG
CTGACAGTGGTCCCCCATTAGCGAATGTATTACCTGAGAC
ATCTTTGTTAGGATTTTGAA
TATTGTCTGGCCCGCGGGGTATTATTATGTAATCCAACCA
AGCCATTGTCTGCTCCCGGC
GAAGTCCGGACACGGTTTCAGTGCTACCGCAACCAAAAGC
CACCAACATTCCTTGCCTTC
TGCTTTCTTCATCAACGGACTACTCCTTCTGACTTCGCCTT
TATTATCATGAACTGTGGC
ATCTACCTACCCAGAATCACTTGTTCTTGAATTAGTTGCCT
TAATAGTAAGCAGGCCACA
AGAAGGCTTTTTGGCActgaggtaccaccagtgttgtggcatAAAAAAGC
ACCGACTCGG
TGCCACTTTTTCAAGTTGATAACGGACTAGCCTTATTTTAA
CTTGCTATTTCTAGCTCTA
aaacCCGTGTTCAATCGTGATAAGCATTAGCGAATGTATTAC
CTGAGACATCTTTGTTAG
GATTTTGAATATTGTCTGGCCCGCGGGGTATTATTATGTAA
TCCAACCAAGCCATTGTCT
GCTCCCGGCGAAGTCCGGACACGGTTTCAGTGCTACCGCA
ACCAAAAGCCACCAACATTC
CTTGCCTTCTGCTTTCTTCATCAACGGACTACTCCTTCTGA
CTTCGCCTTTATTATCATG
AACTGTGGCATCTACCTACCCAGAATCACTTGTTCTTGAAT
TAGTTGCCTTAATAGTAAG
CAGGCCACAAGAAGGCTTTTTGGCAagccggtaccaccagtgttgtggc
atAAAAAAGCA |

TABLE 24-continued

Additional Exemplary gene editing plasmids

| SEQ ID NO | Name | Sequence |
|---|---|---|
| | | CCGACTCGGTGCCACTTTTTCAAGTTGATAACGGACTAGC<br>CTTATTTTAACTTGCTATTT<br>CTAGCTCTAaaacTTGCGGTATAACCGGAGATGCATTAGCG<br>AATGTATTACCTGAGACAT<br>CTTTGTTAGGATTTTGAATATTGTCTGGCCCGCGGGGTATT<br>ATTATGTAATCCAACCAAG<br>CCATTGTCTGCTCCCGGCGAAGTCCGGACACGGTTTCAGT<br>GCTACCGCAACCAAAAGCCA<br>CCAACATTCCTTGCCTTCTGCTTTCTTCATCAACGGACTAC<br>TCCTTCTGACTTCGCCTTT<br>ATTATCATGAACTGTGGCATCTACCTACCCAGAATCACTT<br>GTTCTTGAATTAGTTGCCTT<br>AATAGTAAGCAGGCCACAAGAAGGCTTTTTGGCAtgttggtacc<br>accagtgttgtggcat<br>AAAAAAGCACCGACTCGGTGCCACTTTTTCAAGTTGATAA<br>CGGACTAGCCTTATTTTAAC<br>TTGCTATTTCTAGCTCTAaaacTCATGGAGCCAGATATCCAA<br>CATTAGCGAATGTATTAC<br>CTGAGACATCTTTGTTAGGATTTTGAATATTGTCTGGCCCG<br>CGGGGTATTATTATGTAAT<br>CCAACCAAGCCATTGTCTGCTCCCGGCGAAGTCCGGACAC<br>GGTTTCAGTGCTACCGCAAC<br>CAAAAGCCACCAACATTCCTTGCCTTCTGCTTTCTTCATCA<br>ACGGACTACTCCTTCTGAC<br>TTCGCCTTTATTATCATGAACTGTGGCATCTACCTACCCAG<br>AATCACTTGTTCTTGAATT<br>AGTTGCCTTAATAGTAAGCAGGCCACAAGAAGGCTTTTTG<br>GCAaggtggtacctggtgcg<br>atcgctgttggcgcgccgtgtttaattaaggttgcggccgcttacttcgtccgagcctag<br>ttcgagccttgacaggatatattggcgggtaaactaagtcgctgtatgtgtttgtttgag<br>atctcatgtgagcaaaaggccagcaaaaggccaggaaccgtaaaaaggccgcgttgctgg<br>cgtttttccataggctccgcccccctgacgagcatcacaaaaatcgacgctcaagtcaga<br>ggtggcgaaacccgacaggactataaagataccaggcgtttccccctggaagctccctcg<br>tgcgctctcctgttccgaccctgccgcttaccggatacctgtccgcctttctcccttcgg<br>gaagcgtggcgctttctcatagctcacgctgtaggtatctcagttcggtgtaggtcgttc<br>gctccaagctgggctgtgtgcacgaaccccccgttcagcccgaccgctgcgccttatccg<br>gtaactatcgtcttgagtccaacccggtaagacacgacttatcgccactggcagcagcca<br>ctggtaacaggattagcagagcgaggtatgtaggcggtgctacagagttcttgaagtggt<br>ggcctaactacggctacactagaagaacagtatttggtatctgcgctctgctgaagccag<br>ttaccttcggaagaagagttggtagctcttgatccggcaaacaaaccaccgctggtagcg<br>gtggtttttttgtttgcaagcagcagattacgcgcagaaaaaaaggatctcaagaagatc<br>ctttgatcttttctacggggtctgacgctcagtggaacgaaaactcacgttaagggattt<br>tggtcatgagattatcaaaaaggatcttcacctagatccttttaaattaaaaatgaagtt<br>ttaaatcaatctaaagtatatatgtgtaacattggtctagtgattatttgccgactacct<br>tggtgatctcgcctttcacgtagtgaacaaattcttccaactgatctgcgcgcgaggcca<br>agcgatcttcttgtccaagataagcctgcctagcttcaagtatgacgggctgatactggg<br>ccgcaggcgctccattgcccagtcggcagcgacatccttcggcgcgattttgccggtta<br>ctgcgctgtaccaaatgcgggacaacgtaagcactacatttcgctcatcgccagcccagt<br>cgggcggcgagttccatagcgttaaggtttcatttagcgcctcaaatagatcctgttcag<br>gaaccggatcaaagagttcctccgccgctggacctaccaaggcaacgctatgttctcttg<br>cttttgtcagcaagatagccagatcaatgtcgatcgtgtggctggctcgaagatacctgcaa<br>gaatgtcattgcgctgccattctccaaattg |
| 603 | MG003_<br>AL056_<br>pGGZ003_<br>InterGg1_<br>InterGg2_<br>TrpEg1_<br>TrpEg2_<br>Cas9_<br>MGFHyg | cagttcgcgcttagctggataacgccacggaatgatgtcgtcgtgcacaacaatggtgac<br>ttctacagcgcggagaatctcgctctctccaggggaagccgaagtttccaaaaggtcgtt<br>gatcaaagctcgccgcgttgtttcatcaagccttacggtcaccgtaaccagcaaatcaat<br>atcactgtgtggcttcaggccgccatccactgcggagccgtacaaatgtacggccagcaa<br>cgtcggttcgagatggcgctcgatgacgccaactacctctgatagttgagtcgatacttc<br>ggcgatcaccgcttccctcataacaccccttgtattactgtttatgtaagcagacagttt<br>tattgttcatgatgatatattttttatcttgtgcaatgtaacatcagagattttgagacac<br>aacgtggctttgttgaataaatcgaacttttgctgagttgaaggatcagatcacgcatct<br>tcccgacaacgcagaccgttccgtggcaaagcaaaagttcaaaatcaccaactggtccac<br>ctacaacaaagctctcatcaaccgtggctccctcacttttctggctggatgatgggcgat<br>tcaggcgatccccatccaacagcccgccgtcgagcgggcttttttatccccggaagcctg<br>tggatagagggtagttatccacgtgaaaccgctaatgccccgcaaagccttgattcacgg<br>gcctttccggcccgctccaaaaactatccacgtgaaatcgctaatcagggtacgtgaaat<br>cgctaatcggagtacgtgaaatcgctaataaggtcacgtgaaatcgctaatcaaaaaggc<br>acgtgagaacgctaatagcccttcagatcaacagcttgcaaacacccctcgctccggca<br>agtagttacagcaagtagtatgttcaattagcttttcaattatgaatatatatcaatt<br>attggtcgccttggcttgtggacaatgcgctacgcgcaccggctccgcccgtggacaac<br>cgcaagcggttgcccaccgtcgagcgcctttgcccacaacccggcggccggccgcaacag<br>atcgttttataaattttttttttgaaaaagaaaaagcccgaaaggcggcaacctctcgg<br>gcttctgatttccgatccccggaattagatcttggcaggatatattgtggtgtaacgtt<br>ggatctggctgagaacgccagctgtgcatgcttggtctagaatacGATCTGGATTTTA<br>GT |

TABLE 24-continued

Additional Exemplary gene editing plasmids

| SEQ ID NO Name | Sequence |
|---|---|
| | ACTGGATTTTGGTTTTAGGAATTAGAAATTTTATTGATAGA
AGTATTTTACAAATACAAA
TACATACTAAGGGTTTCTTATATGCTCAACACATGAGCGA
AACCCTATAGGAACCCTAAT
TCCCTTATCTGGGAACTACTCACACATTATTATGGAGAAA
CTCGAGCTTGTCGATCGACA
GATCCGGTCGGCATCTACTCTATTTCTTTGCCCTCGGACGA
GTGCTGGGGCGTCGGTTTC
CACTATCGGCGAGTACTTCTACACAGCCATCGGTCCAGAC
GGCCGCGCTTCTGCGGGCGA
TTTGTGTACGCCCGACAGTCCCGGCTCCGGATCGGACGAT
TGCGTCGCATCGACCCTGCG
CCCAAGCTGCATCATCGAAATTGCCGTCAACCAAGCTCTG
ATAGAGTTGGTCAAGACCAA
TGCGGAGCATATACGCCCGGAGTCGTGGCGATCCTGCAAG
CTCCGGATGCCTCCGCTCGA
AGTAGCGCGTCTGCTGCTCCATACAAGCCAACCACGGCCT
CCAGAAGAAGATGTTGGCGA
CCTCGTATTGGGAATCCCCGAACATCGCCTCGCTCCAGTC
AATGACCGCTGTTATGCGGC
CATTGTCCGTCAGGACATTGTTGGAGCCGAAATCCGCGTG
CACGAGGTGCCGGACTTCGG
GGCAGTCCTCGGCCCAAAGCATCAGCTCATCGAGAGCCTG
CGCGACGGACGCACTGACGG
TGTCGTCCATCACAGTTTGCCAGTGATACACATGGGGATC
AGCAATCGCGCATATGAAAT
CACGCCATGTAGTGTATTGACCGATTCCTTGCGGTCCGAA
TGGGCCGAACCCGCTCGTCT
GGCTAAGATCGGCCGCAGCGATCGCATCCATAGCCTCCGC
GACCGGTTGTAGAACAGCGG
GCAGTTCGGTTTCAGGCAGGTCTTGCAACGTGACACCCTG
TGCACGGCGGGAGATGCAAT
AGGTCAGGCTCTCGCTAAACTCCCCAATGTCAAGCACTTC
CGGAATCGGGAGCGCGGCCG
ATGCAAAGTGCCGATAAACATAACGATCTTTGTAGAAACC
ATCGGCGCAGCTATTTACCC
GCAGGACATATCCACGCCCTCCTACATCGAAGCTGAAAGC
ACGAGATTCTTCGCCCTCCG
AGAGCTGCATCAGGTCGGAGACGCTGTCGAACTTTTCGAT
CAGAAACTTCTCGACAGACG
TCGCGGTGAGTTCAGGCTTTTTCATATCTCATTGCCCCCCG
GGATCTGCGAAAGCTCGAG
AGAGATAGATTTGTAGAGAGAGACTGGTGATTTCAGCGTG
TCCTCTCCAAATGAAATGAA
CTTCCTTATATAGAGGAAGGTCTTGCGAAGGATAGTGGGA
TTGTGCGTCATCCCTTACGT
CAGTGGAGATATCACATCAATCCACTTGCTTTGAAGACGT
GGTTGGAACGTCTTCTTTTT
CCACGATGCTCCTCGTGGGTGGGGGTCCATCTTTGGGACC
ACTGTCGGCAGAGGCATCTT
GAACGATAGCCTTTCCTTTATCGCAATGATGGCATTTGTA
GGTGCCACCTTCCTTTTCTA
CTGTCCTTTTGATGAAGTGACAGATAGCTGGGCAATGGAA
TCCGAGGAGGTTTCCCGATA
TTACCCTTTGTTGAAAAGTCTCAATAGCCCTTTGGTCTTCT
GAGACTGTATCTTTGATAT
TCTTGGAGTAGACGAGAGTGTCGTGCTCCACCATGTTATC
ACATCAATCCACTTGCTTTG
AAGACGTGGTTGGAACGTCTTCTTTTTCCACGATGCTCCTC
GTGGGTGGGGGTCCATCTT
TGGGACCACTGTCGGCAGAGGCATCTTGAACGATAGCCTT
TCCTTTATCGCAATGATGGC
ATTTGTAGGTGCCACCTTCCTTTTCTACTGTCCTTTTGATG
AAGTGACAGATAGCTGGGC
AATGGAATCCGAGGAGGTTTCCCGATATTACCCTTTGTTG
AAAAGTCTCAtagtGATCTG
GATTTTAGTACTGGATTTTGGTTTTAGGAATTAGAAATTTT
ATTGATAGAAGTATTTTAC
AAATACAAATACATACTAAGGGTTTCTTATATGCTCAACA
CATGAGCGAAACCCTATAGG
AACCCTAATTCCCTTATCTGGGAACTACTCACACATTATTA
TGGAGAAACTCGAGCTTGT
CGATCGACAGATCCGGTCGGCATCTACTtcagacttttctttttttttttggt
gctgctg
ggactccatggattccatctcctcccaattgtgacaaatcgattcttgtttcatacaatc |

TABLE 24-continued

Additional Exemplary gene editing plasmids

| SEQ ID NO Name | Sequence |
|---|---|
| | ctgtgattgattgatggatcaatgttgcatccaagacttcttttgttgatgtatatcttt ttctatcgattgttgtatcgaaatatttgaatgctgctggtgctcccaagtttgtcaatg tgaacaaatggatgatgttttctgcttgttctctgattggtttatctctatgtttgttat atgctgacaagactttatccaagtttgcatctgccaagatgactcttttttgagaattctg agatttgttcgatgatttcatccaaataatgtttatgttgttcgacgaacaattgttttt gttcgttatcttctggtgatcctttcaattttcataatgtgatgccaaatacaagaagt tgacatatttgatggcaatgccaattcgtttccttttgcaattctcctgctgatgcca acattcttttcttccgttttccaattcgaacaatgaatattttggcaatttgatgatca aatctttttgacttcttatatccttttgcttccaagaaatcgattgggttttttttcga atgatgatctttccatgattgtgattcccaacaattctttgactgatttcaatttttg attttcctttttcgacttttgcgacgaccaagactgaatatgcgactgttggtgaatcga atcctccataatttttggatcccaatctttttttcttgcgatcaatttatctgagttttc tttttggcaagattgattcttttgagaatcctcctgtttggacttctgttttttgacga tgttgacttgtggcattgacaagacttttctgactgttgcgaaatctcttcctttatccc agacgatttctcctgtttctccgtttgtttcgatcaatggtcttttctgatttctccgt ttgccaatgtgatttctgtttgaagaagttcatgatgtttgaatagaagaaatattttg ctgttgcttttccgatttcttgttctgatttttgcgatcatttttctgacatcatagactt tataatctccatagacgaattctgattccaattttggatatttttgatcaatgctgttc cgacgactgcgttcaaatatgcatcatgtgcatgatgatagttgttgatttctctgactt tatagaattggaaatcttttctgaaatctgaaccaattttgatttcaatgtgatgactt tgacttctctgatcaatttatcgttttcatcatattttgtgttcattcttgaatccaaga tttgtgcgacatgtttgtgatttgtcttgtttcgaccaattgtcttttgatgaatcctg ctttatccaattctgacaatcctcctctttctgcttttgtcaagttatcgaattttcttt gtgtgatcaattttgcgttcaacaattgtctccaatagttttcatttttttgacgactt ctttctgatgggacgttatctgattttcctctgtttttatctgatcttgtcaagactttgt tatcgattgaatcatctttcaagaatgattgtgggacgatatgatcgacatcataatctg acaatctgttgatatccaattcttgatcgacatacatatctcttccgttttgcaaataat acaaatacaattttcgttttgcaattgtgtgtttcgactggatgttcttcaagatttt gtgatcccaattctttgattccttcttcgattcttttcattcttctcttgagtttttt gtccttttgtgttgtttggttttctcttgccatttcgatgacgatgttttctggtttat gtcttcccatgactttgaccaattcatcgacgactttgactgtttgcaagattccttttt tgattgctggtgatcctgccaagtttgcgatatgttcatgcaatgaatctccttgtcctg agacttgtgcttttggatatcttctttgaatgtcaatgaatcatcatggatcaattgca tgaagtttctgtttgcgaatccatctgatttcaagaaatccaagattgttttcctgatt gtttatctctgattccgttgatcaattttcttgacaatcttcccatcctgtatatcttc ttcttttcaattgtttcatgactttatcatcgaacaaatgtgcatatgttttcaatcttt cttcgatcatttctctatcttcgaacaatgtcaatgtcaagacgatatcttccaagatat cttcgttttcttcgttatccaagaaatctttatctttgatgattttcaacaaatcatgat atgttcccaatgatgcgttgaatctatcttcgactcctgagatttcgactgaatcgaagc attcgatttttttgaaataatcttctttcaattgtttgactgtgacttttctgtttgttt tgaacaacaaatcgacgatgctttttttttgttctcctgacaagaatgctggttttctca ttccttctgtgacatatttgactttgtcaattcgttatagactgtgaaatattcataca acaatgaatgttttggcaagactttttcgtttggcaagttttatcgaagtttgtcattc tttcgatgaatgattgtgctgatgctccttatcgacgacttcttcgaagttccatggtg tgattgtttcttctgatttcttgtcatccatgcgaatcttgagtttcctcttgccaatg gtccgacataatatgggattctgaatgtcaagattttttcgatttttctctgttatctt tcaagaatggatagaaatcttcttgtcttctcaagattgcatgcaattctcccaaatgga tttgatgtgggattgatccgttatcgaatgttctttgttttctcaacaaatcttctctgt tcaatttgaccaacaattcttcgttccatccattttttccaagattggttgatgaatt tatagaattcttcttgtgatgctcctccatcgatatatcctgcatatccgttttttgatt gatcgaagaagatttctttatattttctggcaattgttgtctgaccaatgctttcaaca atgtcaaatcttgatgatgttcatcatatcttttgatcattgatgctgacaatggtgctt ttgtgatttctgtgttgactctcaagatatctgacaacaagattgcatctgacaagtttt ttgctgccaagaacaaatctgcatattgatctccgatttgtgccaacaagttatccaaat catcatcatatgtatctttgacaattgcaattttgcatcttctgccaaatcgaagtttg atttgaagtttggtgtcaatcccaatgacaatgcgatcaagtttccgaacaatccgtttt tttttttctcctggcaattgtgcgatcaagttttccaatcttcttgattttgacaatcttg ctgacaagattgcttttgcatcgactcctgatgcgttgattgggttttcttcgaacaatt ggttatatgtttggaccaattggatgaacaatttatcgacatctgagttatctgggttca aatctccttcgatcaagaaatgtcctctgaatttgatcatatgtgccaatgccaaataga tcaatctcaaatctgcttatctgttgaatcgaccaatttttttctcaaatgatagattg ttggatattttcatgatatgcgacttcatcgacgatgtttccgaagattggatgctcttt catgttttttatcttcttcgaccaagaatgattcttccaatctatggaagaatgaatcat cgacttttgccatttcgtttgagaagatttcttgcaaatagcagattctgtttttttcttc ttgtatatcttcttcttgctgttcttttcaatcttgttgcttctgctgtttctcctgaat cgaacaacaatgctccgatcaagttttttttgattgaatgtctatctgtgtttcccaaga ctttgaatttttttgatgggactttatattcatctgtgatgactgccatccgactgagt ttgttccgatatccaatccgattgaatattttttatctgctgctgggactccatggattc cgacttttcttttttttttggtgctgctttatcatcatcatctttataatcgatatcat gatctttataatctccatcatgatctttataatcTTTAACCTACAAGTCGACATC AGTGA GCTGCTGGGTGGTATGCAAGCGAGAGACAAACCATggtaccG GCGATGAGCTTGTTGTGT GTAGATGGGAGAAAACGGAGATGGTGGATGTGACCGGAA TTGGGGTTTTTGTACTATCGA |

TABLE 24-continued

Additional Exemplary gene editing plasmids

| SEQ ID NO | Name | Sequence |
|---|---|---|
| | | TGTCATCACAAATTATTATCATATCAGATTGCTAACCCCTA<br>AACACCGAGAACATTCGAG<br>ACGCGGGAACAGCAGCTCTAGATCCTCAACGCTTATAAAC<br>TGCTAGCCTGACACAGAATG<br>ACGCAAGCCTCGAAAATGCTCTATTGTTAAAAACGTACTG<br>AACTTTCAATCTACTTGCGG<br>ACCTCTTAATTCTTCTTCGCTACATACACAACCTCATCGCA<br>GACTCTACGCGCATATCCC<br>CACTCATTATCATACCATGCAACTAATTTCATAAAACGCG<br>AGTTCAACGCGATGCCCGCT<br>TTTGCGTCAAAGATCATCGAATAGTTGCTCCCAACGAAAT<br>CGGTGGAAACAACGTCTTCT<br>TCCGTATAGTCGACAATGCCTTTCTCGATGCCCGGGTGTTT<br>ACCGTCGGCTGCGTCTTTC<br>AGAGCTCgcagggtaccaccagtgttgtggcatAAAAAAGCACCGACTC<br>GGTGCCACTTT<br>TTCAAGTTGATAACGGACTAGCCTTATTTTAACTTGCTATT<br>TCTAGCTCTAaaacCACTG<br>CTGACAGTGGTCCCCCATTAGCGAATGTATTACCTGAGAC<br>ATCTTTGTTAGGATTTTGAA<br>TATTGTCTGGCCCGCGGGGTATTATTATGTAATCCAACCA<br>AGCCATTGTCTGCTCCCGGC<br>GAAGTCCGGACACGGTTTCAGTGCTACCGCAACCAAAAGC<br>CACCAACATTCCTTGCCTTC<br>TGCTTTCTTCATCAACGGACTACTCCTTCTGACTTCGCCTT<br>TATTATCATGAACTGTGGC<br>ATCTACCTACCCAGAATCACTTGTTCTTGAATTAGTTGCCT<br>TAATAGTAAGCAGGCCACA<br>AGAAGGCTTTTTGGCActgaggtaccaccagtgttgtggcatAAAAAAGC<br>ACCGACTCGG<br>TGCCACTTTTTCAAGTTGATAACGGACTAGCCTTATTTTAA<br>CTTGCTATTTCTAGCTCTA<br>aaacTCGTTTGATGGTACCAGCAACATTAGCGAATGTATTAC<br>CTGAGACATCTTTGTTAG<br>GATTTTGAATATTGTCTGGCCCGCGGGGTATTATTATGTAA<br>TCCAACCAAGCCATTGTCT<br>GCTCCCGGCGAAGTCCGGACACGGTTTCAGTGCTACCGCA<br>ACCAAAAGCCACCAACATTC<br>CTTGCCTTCTGCTTTCTTCATCAACGGACTACTCCTTCTGA<br>CTTCGCCTTTATTATCATG<br>AACTGTGGCATCTACCTACCCAGAATCACTTGTTCTTGAAT<br>TAGTTGCCTTAATAGTAAG<br>CAGGCCACAAGAAGGCTTTTTGGCAagccggtaccaccagtgttgtggc<br>atAAAAAAGCA<br>CCGACTCGGTGCCACTTTTTCAAGTTGATAACGGACTAGC<br>CTTATTTTAACTTGCTATTT<br>CTAGCTCTAaaacCCTATAGTCTCCTCCTTCGACATTAGCGA<br>ATGTATTACCTGAGACAT<br>CTTTGTTAGGATTTTGAATATTGTCTGGCCCGCGGGGTATT<br>ATTATGTAATCCAACCAAG<br>CCATTGTCTGCTCCCGGCGAAGTCCGGACACGGTTTCAGT<br>GCTACCGCAACCAAAAGCCA<br>CCAACATTCCTTGCCTTCTGCTTTCTTCATCAACGGACTAC<br>TCCTTCTGACTTCGCCTTT<br>ATTATCATGAACTGTGGCATCTACCTACCCAGAATCACTT<br>GTTCTTGAATTAGTTGCCTT<br>AATAGTAAGCAGGCCACAAGAAGGCTTTTTGGCAtgttggtacc<br>accagtgttgtggcat<br>AAAAAAGCACCGACTCGGTGCCACTTTTTCAAGTTGATAA<br>CGGACTAGCCTTATTTTAAC<br>TTGCTATTTCTAGCTCTAaaacCAGATTGGTGAAATGTTCAC<br>CATTAGCGAATGTATTAC<br>CTGAGACATCTTTGTTAGGATTTTGAATATTGTCTGGCCCG<br>CGGGGTATTATTATGTAAT<br>CCAACCAAGCCATTGTCTGCTCCCGGCGAAGTCCGGACAC<br>GGTTTCAGTGCTACCGCAAC<br>CAAAAGCCACCAACATTCCTTGCCTTCTGCTTTCTTCATCA<br>ACGGACTACTCCTTCTGAC<br>TTCGCCTTTATTATCATGAACTGTGGCATCTACCTACCCAG<br>AATCACTTGTTCTTGAATT<br>AGTTGCCTTAATAGTAAGCAGGCCACAAGAAGGCTTTTTG<br>GCAaggtggtacctggtgcg<br>atcgctgttggcgcgccgtgtttaattaaggttgcggccgcttacttcgtccgagcctag<br>ttcgagccttgacaggatatattggcgggtaaactaagtcgctgtatgtgtttgtttgag<br>atctcatgtgagcaaaaggccagcaaaaggccaggaaccgtaaaaaggccgcgttgctgg |

TABLE 24-continued

Additional Exemplary gene editing plasmids

| SEQ ID NO | Name | Sequence |
|---|---|---|
| | | cgtttttccataggctccgcccccctgacgagcatcacaaaaatcgacgctcaagtcaga<br>ggtggcgaaacccgacaggactataaagataccaggcgtttccccctggaagctccctcg<br>tgcgctctcctgttccgaccctgccgcttaccggatacctgtccgcctttctcccttcgg<br>gaagcgtggcgctttctcatagctcacgctgtaggtatctcagttcggtgtaggtcgttc<br>gctccaagctgggctgtgtgcacgaaccccccgttcagcccgaccgctgcgccttatccg<br>gtaactatcgtcttgagtccaacccggtaagacacgacttatcgccactggcagcagcca<br>ctggtaacaggattagcagagcgaggtatgtaggcggtgctacagagttcttgaagtggt<br>ggcctaactacggctacactagaagaacagtatttggtatctgcgctctgctgaagccag<br>ttaccttcggaagaagagttggtagctcttgatccggcaaacaaaccaccgctggtagcg<br>gtggtttttttgtttgcaagcagcagattacgcgcagaaaaaaaggatctcaagaagatc<br>ctttgatcttttctacggggtctgacgctcagtggaacgaaaactcacgttaagggattt<br>tggtcatgagattatcaaaaaggatcttcacctagatccttttaaattaaaaatgaagtt<br>ttaaatcaatctaaagtatatatgtgtaacattggtctagtgattatttgccgactacct<br>tggtgatctcgcctttcacgtagtgaacaaattcttccaactgatctgcgcgcgaggcca<br>agcgatcttcttgtccaagataagcctgcctagcttcaagtatgacgggctgatactggg<br>ccggcaggcgctccattgcccagtcggcagcgacatccttcggcgcgattttgccggtta<br>ctgcgctgtaccaaatgcgggacaacgtaagcactacatttcgctcatcgccagcccagt<br>cgggcggcgagttccatagcgttaaggtttcatttagcgcctcaaatagatcctgttcag<br>gaaccggatcaaagagttcctccgccgctggacctaccaaggcaacgctatgttctcttg<br>cttttgtcagcaagatagccagatcaatgtcgatcgtggctggctcgaagatacctgcaa<br>gaatgtcattgcgctgccattctccaaattg |
| 604 | MG004_<br>AL056_<br>pGGZ003_<br>InterGg1_<br>InterGg2_<br>GFPD-<br>dummy_<br>Cas9_<br>MGFHyg | cagttcgcgcttagctggataacgccacggaatgatgtcgtcgtgcacaacaatggtgac<br>ttctacagcgcggagaatctcgctctctccaggggaagccgaagtttccaaaaggtcgtt<br>gatcaaagctcgccgcgttgtttcatcaagccttacggtcaccgtaaccagcaaatcaat<br>atcactgtgtggcttcaggccgccatccactgcggagccgtacaaatgtacggccagcaa<br>cgtcggttcgagatggcgctcgatgacgccaactacctctgatagttgagtcgatacttc<br>ggcgatcaccgcttccctcataacacccccttgtattactgtttatgtaagcagacagttt<br>tattgttcatgatgatatatttttatcttgtgcaatgtaacatcagagattttgagacac<br>aacgtggctttgttgaataaatcgaacttttgctgagttgaaggatcagatcacgcatct<br>tcccgacaacgcagaccgttccgtggcaaagcaaaagttcaaaatcaccaactggtccac<br>ctacaacaaagctctcatcaaccgtggctccctcacttttctggctggatgatggggcgat<br>tcaggcgatccccatccaacagcccgccgtcgagcgggcttttttatccccggaagcctg<br>tggatagagggtagttatccacgtgaaacgctaatgccccgcaaagccttgattcacgg<br>ggctttccggccgctccaaaaactatccacgtgaaatcgctaatcagggtacgtgaaat<br>cgctaatcggagtacgtgaaatcgctaataaggtcacgtgaaatcgctaatcaaaaggc<br>acgtgagaacgctaatagcccttttcagatcaacagcttgcaaacacccctcgctccggca<br>agtagttacagcaagtagtatgttcaattagcttttcaattatgaatatatatatcaatt<br>attggtcgcccttggcttgtggacaatgcgctacgcgcaccggctccgcccgtggacaac<br>cgcaagcggttgcccaccgtcgagcgccttgcccacaacccggcggccggccgcaacag<br>atcgttttataaattttttttttgaaaaagaaaaagcccgaaaggcggcaacctcctgg<br>gcttctggatttccgatccccggaattagatcttggcaggatatattgtggtgtaacgtt<br>ggatctggctgagaacgccagctgtgcatgcttggtctagaatacGATCTGGATTTTA<br>GT<br>ACTGGATTTTGGTTTTAGGAATTAGAAATTTTATTGATAGA<br>AGTATTTTACAAATACAAA<br>TACATACTAAGGGTTTCTTATATGCTCAACACATGAGCGA<br>AACCCTATAGGAACCCTAAT<br>TCCCTTATCTGGGAACTACTCACACATTATTATGGAGAAA<br>CTCGAGCTTGTCGATCGACA<br>GATCCGGTCGGCATCTACTCTATTTCTTTGCCCTCGGACGA<br>GTGCTGGGCGTCGGTTTC<br>CACTATCGGCGAGTACTTCTACACAGCCATCGGTCCAGAC<br>GGCCGCGCTTCTGCGGGCGA<br>TTTGTGTACGCCCGACAGTCCCGGCTCCGGATCGGACGAT<br>TGCGTCGCATCGACCCTGCG<br>CCCAAGCTGCATCATCGAAATTGCCGTCAACCAAGCTCTG<br>ATAGAGTTGGTCAAGACCAA<br>TGCGGAGCATATACGCCCGGAGTCGTGGCGATCCTGCAAG<br>CTCCGGATGCCTCCGCTCGA<br>AGTAGCGCGTCTGCTGCTCCATACAAGCCAACCACGGCCT<br>CCAGAAGAAGATGTTGGCGA<br>CCTCGTATTGGGAATCCCCGAACATCGCCTCGCTCCAGTC<br>AATGACCGCTGTTATGCGGC<br>CATTGTCCGTCAGGACATTGTTGGAGCCGAAATCCGCGTG<br>CACGAGGTGCCGGACTTCGG<br>GGCAGTCCTCGGCCCAAAGCATCAGCTCATCGAGAGCCTG<br>CGCGACGGACGCACTGACGG<br>TGTCGTCCATCACAGTTTGCCAGTGATACACATGGGGATC<br>AGCAATCGCGCATATGAAAT<br>CACGCCATGTAGTGTATTGACCGATTCCTTGCGGTCCGAA<br>TGGGCCGAACCCGCTCGTCT<br>GGCTAAGATCGGCCGCAGCGATCGCATCCATAGCCTCCGC<br>GACCGGTTGTAGAACAGCGG<br>GCAGTTCGGTTTCAGGCAGGTCTTGCAACGTGACACCCTG |

TABLE 24-continued

Additional Exemplary gene editing plasmids

| SEQ ID NO | Name | Sequence |
|---|---|---|
| | | TGCACGGCGGGAGATGCAAT<br>AGGTCAGGCTCTCGCTAAACTCCCCAATGTCAAGCACTTC<br>CGGAATCGGGAGCGCGGCCG<br>ATGCAAAGTGCCGATAAACATAACGATCTTTGTAGAAACC<br>ATCGGCGCAGCTATTTACCC<br>GCAGGACATATCCACGCCCTCCTACATCGAAGCTGAAAGC<br>ACGAGATTCTTCGCCCTCCG<br>AGAGCTGCATCAGGTCGGAGACGCTGTCGAACTTTTCGAT<br>CAGAAACTTCTCGACAGACG<br>TCGCGGTGAGTTCAGGCTTTTTCATATCTCATTGCCCCCCG<br>GGATCTGCGAAAGCTCGAG<br>AGAGATAGATTTGTAGAGAGACTGGTGATTTCAGCGTG<br>TCCTCTCCAAATGAAATGAA<br>CTTCCTTATATAGAGGAAGGTCTTGCGAAGGATAGTGGGA<br>TTGTGCGTCATCCCTTACGT<br>CAGTGGAGATATCACATCAATCCACTTGCTTTGAAGACGT<br>GGTTGGAACGTCTTCTTTTT<br>CCACGATGCTCCTCGTGGGTGGGGGTCCATCTTTGGGACC<br>ACTGTCGGCAGAGGCATCTT<br>GAACGATAGCCTTTCCTTTATCGCAATGATGGCATTTGTA<br>GGTGCCACCTTCCTTTTCTA<br>CTGTCCTTTTGATGAAGTGACAGATAGCTGGGCAATGGAA<br>TCCGAGGAGGTTTCCCGATA<br>TTACCCTTTGTTGAAAAGTCTCAATAGCCCTTTGGTCTTCT<br>GAGACTGTATCTTTGATAT<br>TCTTGGAGTAGACGAGAGTGTCGTGCTCCACCATGTTATC<br>ACATCAATCCACTTGCTTTG<br>AAGACGTGGTTGGAACGTCTTCTTTTTCCACGATGCTCCTC<br>GTGGGTGGGGGTCCATCTT<br>TGGGACCACTGTCGGCAGAGGCATCTTGAACGATAGCCTT<br>TCCTTTATCGCAATGATGGC<br>ATTTGTAGGTGCCACCTTCCTTTTCTACTGTCCTTTTGATG<br>AAGTGACAGATAGCTGGGC<br>AATGGAATCCGAGGAGGTTTCCCGATATTACCCTTTGTTG<br>AAAAGTCTCAtagtGATCTG<br>GATTTTAGTACTGGATTTTGGTTTTAGGAATTAGAAATTTT<br>ATTGATAGAAGTATTTTAC<br>AAATACAAATACATACTAAGGGTTTCTTATATGCTCAACA<br>CATGAGCGAAACCCTATAGG<br>AACCCTAATTCCCTTATCTGGGAACTACTCACACATTATTA<br>TGGAGAAACTCGAGCTTGT<br>CGATCGACAGATCCGGTCGGCATCTACTtcagacttttctttttttttttggt<br>gctgctg<br>ggactccatggattccatctcctcccaattgtgacaaatcgattcttgtttcatacaatc<br>ctgtgattgattgatggatcaatgttgcatccaagacttctttttgttgatgtatatcttt<br>ttctatcgattgttgtatcgaaatatttgaatgctgctggtgctcccaagtttgtcaatg<br>tgaacaaatggatgatgttttctgcttgttctctgattggtttatctctatgtttgttat<br>atgctgacaagactttatccaagtttgcatctgccaagatgactcttttgagaattctg<br>agatttgttcgatgatttcatccaaataatgtttatgttgttcgacgaacaattgttttt<br>gttcgttatcttctggtgatccttcaattttcataatgtgatgccaaatacaagaagt<br>tgacatatttgatggcaatgccaattcgtttccttttgcaattctcctgctgatgcca<br>acattcttttcttccgttttccaattcgaacaatgaatattttggcaatttgatgatca<br>aatctttttgacttctttatatcctttgcttccaagaaatcgattgggtttttttcga<br>atgatgatctttccatgattgtgattcccaacaattctttgactgatttcaattttttg<br>attttcctttttcgacttttgcgacgaccaagactgaatatgcgactgttggtgaatcga<br>atcctccatatttttggatcccaatcttttttcttgcgatcaatttatctgagtttc<br>tttttggcaagattgattcttttgagaatcctcctgtttggacttctgttttttgacga<br>tgttgacttgtggcattgacaagacttttctgactgttgcgaaatctcttccttatccc<br>agacgatttctcctgtttctccgtttgtttcgatcaatggtcttttctgatttctccgt<br>ttgccaatgtgatttctgttttgaagaagttcatgatgtttgaatagaagaaatattttg<br>ctgttgcttttccgatttcttgttctgattttgcgatcattttctgacatcatagactt<br>tataatctccatagacgaatttctgattccaattttggatattttttgatcaatgctgttc<br>cgacgactgcgttcaaatatgcatcatgtgcatgatgatagttgttgatttctctgactt<br>tatagaattggaaatcttttctgaaatctgaaaccaattttgatttcaatgtgatgactt<br>tgacttctctgatcaatttatcgttttcatcatattttgtgttcattcttgaatccaaga<br>tttgtgcgacatgttttgtgatttgtcttgtttcgaccaattgtcttttgatgaatcctg<br>cttttatccaattctgacaatcctcctctttctgcttttgtcaagttatcgaattttcttt<br>gtgtgatcaattttgcgttcaacaattgtctccaatagtttttcattttttgacgactt<br>cttctgatgggacgttatctgattttcctctgtttttatctgatcttgtcaagactttgt<br>tatcgattgaatcatctttcaagaatgattgtgggacgatatgatcgacatcataatctg<br>acaatctgttgatatccaattcttgatcgacatacatatctcttccgttttgcaaataat<br>acaaatacaattttcgttttgcaattgtgtgttttcgactggatgttctttcaagattt<br>gtgatcccaattcttttgattccttcttcgattcttttcattctttctcttgagttttttt<br>gtccttttgtgttgtttggttttctcttgccatttcgatgacgatgttttctggttttat<br>gtcttcccatgactttgaccaattcatcgacgactttgactgtttgcaagattccttttt |

TABLE 24-continued

Additional Exemplary gene editing plasmids

| SEQ ID NO | Name | Sequence |
|---|---|---|
| | | tgattgctggtgatcctgccaagtttgcgatatgttcatgcaatgaatctccttgtcctg<br>agacttgtgcttttggatatcttctttgaatgtcaatgaatcatcatggatcaattgca<br>tgaagtttctgtttgcgaatccatctgatttcaagaaatccaagattgttttcctgatt<br>gtttatctctgattccgttgatcaattttcttgacaatcttccccatcctgtatatcttc<br>ttcttttcaattgtttcatgactttatcatcgaacaaatgtgcatatgttttcaatcttt<br>cttcgatcatttctctatcttcgaacaatgtcaatgtcaagacgatatcttccaagatat<br>cttcgttttcttcgttatccaagaaatctttatctttgatgattttcaacaaatcatgat<br>atgttcccaatgatgcgttgaatctatcttcgactcctgagatttcgactgaatcgaagc<br>attcgatttttttgaaataatcttctttcaattgtttgactgtgacttttctgtttgttt<br>tgaacaacaaatcgacgattgcttttttttgttctcctgacaagaatgctggttttctca<br>ttccttctgtgacatatttgactttgtcaattcgttatagactgtgaaatattcataca<br>acaatgaatgttttggcaagactttttcgtttggcaagttttatcgaagtttgtcattc<br>tttcgatgaatgattgtgctgatgctcctttatcgacgacttcttcgaagttccatggtg<br>tgattgtttcttctgattttcttgtcatccatgcgaatcttgagtttcctcttgccaatg<br>gtccgacataatatgggattctgaatgtcaagattttttcgattttttctctgttatctt<br>tcaagaatggatagaaatcttcttgtcttctcaagattgcatgcaattctcccaaatgga<br>tttgatgtgggattgatccgttatcgaatgttctttgttttctcaacaaatcttctctgt<br>tcaatttgaccaacaattcttctgttccatccatttttccaagattggtttgatgaatt<br>tatagaattcttcttgtgatgctcctccatcgatatatcctgcatatccgttttttgatt<br>gatcgaagaagatttctttatatttttctggcaattgttgtctgaccaatgctttcaaca<br>atgtcaaatcttgatgatgttcatcatatcttttgatcattgatgctgacaatggtgctt<br>ttgtgatttctgtgttgactctcaagatatctgacaacaagattgcatctgacaagtttt<br>ttgctgccaagaacaaatctgcatattgatctccgatttgtgccaacaagttatccaaat<br>catcatcatatgtatctttgacaattgcaatttgcatcttctgccaaatcgaagtttg<br>atttgaagtttggtgtcaatcccaatgacaatgcgatcaagtttccgaacaatccgtttt<br>ttttttctcctggcaattgtgcgatcaagttttccaatcttcttgattttgacaatcttg<br>ctgacaagattgcttttgcatcgactcctgatgcgttgattgggttttcttcgaacaatt<br>ggttatatgtttggaccaattggatgaacaatttatcgacatctgagttatctgggttca<br>aatctccttcgatcaagaaatgtcctctgaatttgatcatatgcgcaatgccaaataga<br>tcaatctcaaatctgctttatctgttgaatcgaccaattttttctcaaatgatagattg<br>ttggatattttcatgatatgcgacttcatcgacgatgtttccgaagattggatgtcttt<br>catgttttttatcttcttcgaccaagaatgattcttccaatctatggaagaatgaatcat<br>cgactttgccatttcgtttgagaagatttcttgcaaatagcagattctgtttttcttc<br>ttgtatatcttcttcttgctgttcttttcaatcttgttgcttctgctgtttctcctgaat<br>cgaacaacaatgctccgatcaagttttttttgattgaatgtctatctgtgtttcccaaga<br>ctttgaatttttttgatgggactttatattcatctgtgatgactgcccatccgactgagt<br>ttgttccgatatccaatccgattgaatattttttatctgctgggactccatggattc<br>cgacttttcttttttttttggtgctgcttatcatcatcatcttatatcgatatcat<br>gatctttataatctccatcgatctttataatcTTTAACCTACAAGTCGACATCAGTGA<br>GCTGCTGGGTGGTATGCAAGCGAGAGACAAACCATggtaccG<br>GCGATGAGCTTGTTGTGT<br>GTAGATGGGAGAAAACGGAGATGGTGGATGTGACCGGAA<br>TTGGGGTTTTTGTACTATCGA<br>TGTCATCACAAATTATTATCATATCAGATTGCTAACCCCTA<br>AACACCGAGAACATTCGAG<br>ACGCGGGAACAGCAGCTCTAGATCCTCAACGCTTATAAAC<br>TGCTAGCCTGACACAGAATG<br>ACGCAAGCCTCGAAAATGCTCTATTGTTAAAAACGTACTG<br>AACTTTCAATCTACTTGCGG<br>ACCTCTTAATTCTTCTTCGCTACATACACAACCTCATCGCA<br>GACTCTACGCGCATATCCC<br>CACTCATTATCATACCATGCAACTAATTTCATAAAACGCG<br>AGTTCAACGCGATGCCCGCT<br>TTTGCGTCAAAGATCATCGAATAGTTGCTCCCAACGAAAT<br>CGGTGGAAACAACGTCTTCT<br>TCCGTATAGTCGACAATGCCTTTCTCGATGCCCGGGTGTTT<br>ACCGTCGGCTGCGTCTTTC<br>AGAGCTCgcagggtaccaatttacagggaatgaaggtaaaggttatctaggatccacctg<br>acttgtacagctcgtccatgccgtgagtgatcccggcggcggtcacgaactccagcagga<br>ccatgtgatcgcgcttctcgttgggtctttgctcagcttggactgggtgctcaggtagt<br>ggttgtcgggcagcagcacggggccgtcgccgatgggggtgttctgctggtagtggtgg<br>cgagctgcacgctgccgtcctcgatgttgtggcggatcttgaagttcaccttgatgccgt<br>tcttctgcttgtcggccatgatatagacgttgtggctgttgtagttgtactccagcttgt<br>gccccaggatgttgccgtcctccttgaagtcgatgcccttcagctcgatgcggttcacca<br>gggtgtcgccctcgaacttcacctcggcgcgggtcttgtagttgccgtcgtccttgaaga<br>agatggtgcgctcctggacgtagccttcgggcatggcggacttgaagaagtcgtgctgct<br>tcatgtggtcggggtagcggctgaagcactgcacgccgtaggtgaaggtggtcacgaggg<br>tgggccagggcacgggcagcttgccggtggtgcagatgaacttcagggtcagcttgccgt<br>aggtggcatcgccctcgccctcgccggacacgctgaacttgtggccgttacgtcgccgt<br>ccagctcgaccaggatgggcaccacccggtgaacagctcctcgcccttgctcaccatgg<br>agccggtaccaccagtgttgtggcatAAAAAAGCACCGACTCGGTGCCA<br>CTTTTTCAAGT<br>TGATAACGGACTAGCCTTATTTTAACTTGCTATTTCTAGCT<br>CTAaaacCCTATAGTCTCC |

TABLE 24-continued

Additional Exemplary gene editing plasmids

| SEQ ID NO | Name | Sequence |
|---|---|---|
| | | TCCTTCGACATTAGCGAATGTATTACCTGAGACATCTTTGT<br>TAGGATTTTGAATATTGTC<br>TGGCCCGCGGGGTATTATTATGTAATCCAACCAAGCCATT<br>GTCTGCTCCCGGCGAAGTCC<br>GGACACGGTTTCAGTGCTACCGCAACCAAAAGCCACCAAC<br>ATTCCTTGCCTTCTGCTTTC<br>TTCATCAACGGACTACTCCTTCTGACTTCGCCTTTATTATC<br>ATGAACTGTGGCATCTACC<br>TACCCAGAATCACTTGTTCTTGAATTAGTTGCCTTAATAGT<br>AAGCAGGCCACAAGAAGGC<br>TTTTTGGCAtgttggtaccaccagtgttgtggcatAAAAAAGCACCGACTC<br>GGTGCCACT<br>TTTTCAAGTTGATAACGGACTAGCCTTATTTTAACTTGCTA<br>TTTCTAGCTCTAaaaacCAG<br>ATTGGTGAAATGTTCACCATTAGCGAATGTATTACCTGAG<br>ACATCTTTGTTAGGATTTTG<br>AATATTGTCTGGCCCGCGGGGTATTATTATGTAATCCAAC<br>CAAGCCATTGTCTGCTCCCG<br>GCGAAGTCCGGACACGGTTTCAGTGCTACCGCAACCAAAA<br>GCCACCAACATTCCTTGCCT<br>TCTGCTTTCTTCATCAACGGACTACTCCTTCTGACTTCGCC<br>TTTATTATCATGAACTGTG<br>GCATCTACCTACCCAGAATCACTTGTTCTTGAATTAGTTGC<br>CTTAATAGTAAGCAGGCCA<br>CAAGAAGGCTTTTTGGCAaggtggtacctggtgcgatcgctgttggcgcgccg<br>tgtttaattaaggttgcggccgcttacttcgtccgagcctagttcgagccttgacaggatatattgg<br>cgggtaaactaagtcgctgtatgtgtttgtttgagatctcatgtgagcaaaaggccagca<br>aaaggccaggaaccgtaaaaaggccgcgttgctggcgtttttccataggctccgcccccc<br>tgacgagcatcacaaaaatcgacgctcaagtcagaggtggcgaaacccgacaggactata<br>aagataccaggcgtttccccctggaagctccctcgtgcgctctcctgttccgaccctgcc<br>gcttaccggatacctgtccgcctttctcccttcgggaagcgtggcgctttctcatagctc<br>acgctgtaggtatctcagttcggtgtaggtcgttcgctccaagctgggctgtgtgcacga<br>accccccgttcagcccgaccgctgcgccttatccggtaactatcgtcttgagtccaaccc<br>ggtaagacacgacttatcgccactggcagcagccactggtaacaggattagcagagcgag<br>gtatgtaggcggtgctacagagttcttgaagtggtggcctaactacggctacactagaag<br>aacagtatttggtatctgcgctctgctgaagccagttaccttcggaagaagagttggtag<br>ctcttgatccggcaaacaaaccaccgctggtagcggtggtttttttgtttgcaagcagca<br>gattacgcgcagaaaaaaaggatctcaagaagatcctttgatcttttctacggggtctga<br>cgctcagtggaacgaaaactcacgttaagggattttggtcatgagattatcaaaaaggat<br>cttcacctagatccttttaaattaaaaatgaagttttaaatcaatctaaagtatatatgt<br>gtaacattggtctagtgattatttgccgactaccttggtgatctcgccttcacgtagtg<br>aacaaattcttccaactgatctgcgcgcgaggccaagcgatcttcttgtccaagataagc<br>ctgcctagcttcaagtatgacgggctgatactgggccggcaggcgctccattgcccagtc<br>ggcagcgacatccttcggcgcgattttgccggttactgcgctgtaccaaatgcgggacaa<br>cgtaagcactacatttcgctcatcgccagcccagtcgggcggcgagttccatagcgttaa<br>ggtttcatttagcgcctcaaatagatcctgttcaggaaccggatcaaagagttcctccgc<br>cgctggacctaccaaggcaacgctatgttctcttgcttttgtcagcaagatagccagatc<br>aatgtcgatcgtggctggctcgaagatacctgcaagaatgtcattgcgctgccattctcc<br>aaattg |
| 605 | MG005_<br>AL056_<br>pGGZ003_<br>pRPS5A<br>B-dummy_<br>TrpEg1_<br>TrpEg2_<br>Cas9_<br>MGFHyg | cagttcgcgcttagctggataacgccacggaatgatgtcgtcgtgcacaacaatggtgac<br>ttctacagcgcggagaatctcgctctctccaggggaagccgaagtttccaaaaggtcgtt<br>gatcaaagctcgccgcgttgtttcatcaagccttacggtcaccgtaaccagcaaatcaat<br>atcactgtgtggcttcaggccgccatccactgcggagccgtacaaatgtacggccagcaa<br>cgtcggttcgagatggcgctcgatgacgccaactacctctgatagttgagtcgatacttc<br>ggcgatcaccgcttccctcataacacccccttgtattactgtttatgtaagcagacagttt<br>tattgttcatgatgatatattttttatcttgtgcaatgtaacatcagagattttgagacac<br>aacgtggcttttgttgaataaatcgaacttttgctagttgaaggatcagatcacgcatct<br>tcccgacaacgcagaccgttccgtggcaaagcaaaagttcaaaatcaccaactggtccac<br>ctacaacaaagctctcatcaaccgtggctccctcacttttctggctggatgatgggggcat<br>tcaggcgatccccatccaacagcccgccgtcgagcgggcttttttatcccccggaagcctg<br>tggatagagggtagttatccacgtgaaaccgctaatgccccgcaaagccttgattcacgg<br>ggctttccggcccgctccaaaaactatccacgtgaaatcgctaatcagggtacgtgaaat<br>cgctaatcggagtacgtgaaatcgctaataaggtcacgtgaaatcgctaatcaaaaaggc<br>acgtgagaacgctaatagccccttcagatcaacagcttgcaaacacccctcgctccggca<br>agtagttacagcaagtagtatgttcaattagcttttcaattatgaatatatatatcaatt<br>attggtcgcccttggcttgtggacaatgcgctacgcgcaccggctccgcccgtggacaac<br>cgcaagcggttgcccaccgtcgagcgccttttgcccacaacccggcggccggccgcaacag<br>atcgttttataaatttttttttttttgaaaaagaaaaagcccgaaaggcggcaacctctcgg<br>gcttctggatttccgatcccccggaattagatcttggcaggatatattgtggtgtaacgtt<br>ggaatctggctgagaacgccagctgtgcatgcttggtctagaatacGATCTGGATTTTA<br>GT<br>ACTGGATTTTGGTTTTAGGAATTAGAAATTTTATTGATAGA<br>AGTATTTTACAAATACAAA<br>TACATACTAAGGGTTTCTTATATGCTCAACACATGAGCGA |

TABLE 24-continued

Additional Exemplary gene editing plasmids

| SEQ ID NO Name | Sequence |
|---|---|
| | AACCCTATAGGAACCCTAAT<br>TCCCTTATCTGGGAACTACTCACACATTATTATGGAGAAA<br>CTCGAGCTTGTCGATCGACA<br>GATCCGGTCGGCATCTACTCTATTTCTTTGCCCTCGGACGA<br>GTGCTGGGGCGTCGGTTTC<br>CACTATCGGCGAGTACTTCTACACAGCCATCGGTCCAGAC<br>GGCCGCGCTTCTGCGGGCGA<br>TTTGTGTACGCCCGACAGTCCCGGCTCCGGATCGGACGAT<br>TGCGTCGCATCGACCCTGCG<br>CCCAAGCTGCATCATCGAAATTGCCGTCAACCAAGCTCTG<br>ATAGAGTTGGTCAAGACCAA<br>TGCGGAGCATATACGCCCGGAGTCGTGGCGATCCTGCAAG<br>CTCCGGATGCCTCCGCTCGA<br>AGTAGCGCGTCTGCTGCTCCATACAAGCCAACCACGGCCT<br>CCAGAAGAAGATGTTGGCGA<br>CCTCGTATTGGGAATCCCCGAACATCGCCTCGCTCCAGTC<br>AATGACCGCTGTTATGCGGC<br>CATTGTCCGTCAGGACATTGTTGGAGCCGAAATCCGCGTG<br>CACGAGGTGCCGGACTTCGG<br>GGCAGTCCTCGGCCCAAAGCATCAGCTCATCGAGAGCCTG<br>CGCGACGGACGCACTGACGG<br>TGTCGTCCATCACAGTTTGCCAGTGATACACATGGGGATC<br>AGCAATCGCGCATATGAAAT<br>CACGCCATGTAGTGTATTGACCGATTCCTTGCGGTCCGAA<br>TGGGCCGAACCCGCTCGTCT<br>GGCTAAGATCGGCCGCAGCGATCGCATCCATAGCCTCCGC<br>GACCGGTTGTAGAACAGCGG<br>GCAGTTCGGTTTCAGGCAGGTCTTGCAACGTGACACCCTG<br>TGCACGGCGGGAGATGCAAT<br>AGGTCAGGCTCTCGCTAAACTCCCCAATGTCAAGCACTTC<br>CGGAATCGGGAGCGCGGCCG<br>ATGCAAAGTGCCGATAAACATAACGATCTTTGTAGAAACC<br>ATCGGCGCAGCTATTTACCC<br>GCAGGACATATCCACGCCCTCCTACATCGAAGCTGAAAGC<br>ACGAGATTCTTCGCCCTCCG<br>AGAGCTGCATCAGGTCGGAGACGCTGTCGAACTTTTCGAT<br>CAGAAACTTCTCGACAGACG<br>TCGCGGTGAGTTCAGGCTTTTTCATATCTCATTGCCCCCCG<br>GGATCTGCGAAAGCTCGAG<br>AGAGATAGATTTGTAGAGAGAGACTGGTGATTTCAGCGTG<br>TCCTCTCCAAATGAAATGAA<br>CTTCCTTATATAGAGGAAGGTCTTGCGAAGGATAGTGGGA<br>TTGTGCGTCATCCCTTACGT<br>CAGTGGAGATATCACATCAATCCACTTGCTTTGAAGACGT<br>GGTTGGAACGTCTTCTTTTT<br>CCACGATGCTCCTCGTGGGTGGGGGTCCATCTTTGGGACC<br>ACTGTCGGCAGAGGCATCTT<br>GAACGATAGCCTTTCCTTTATCGCAATGATGGCATTTGTA<br>GGTGCCACCTTCCTTTTCTA<br>CTGTCCTTTTGATGAAGTGACAGATAGCTGGGCAATGGAA<br>TCCGAGGAGGTTTCCCGATA<br>TTACCCTTTGTTGAAAAGTCTCAATAGCCCTTTGGTCTTCT<br>GAGACTGTATCTTTGATAT<br>TCTTGGAGTAGACGAGAGTGTCGTGCTCCACCATGTTATC<br>ACATCAATCCACTTGCTTTG<br>AAGACGTGGTTGGAACGTCTTCTTTTTCCACGATGCTCCTC<br>GTGGGTGGGGTCCATCTT<br>TGGGACCACTGTCGGCAGAGGCATCTTGAACGATAGCCTT<br>TCCTTTATCGCAATGATGGC<br>ATTTGTAGGTGCCACCTTCCTTTTCTACTGTCCTTTTGATG<br>AAGTGACAGATAGCTGGGC<br>AATGGAATCCGAGGAGGTTTCCCGATATTACCCTTTGTTG<br>AAAAGTCTCAtagtGATCTG<br>GATTTTAGTACTGGATTTTGGTTTTAGGAATTAGAAATTTT<br>ATTGATAGAAGTATTTTAC<br>AAATACAAATACATACTAAGGGTTTCTTATATGCTCAACA<br>CATGAGCGAAACCCTATAGG<br>AACCCTAATTCCCTTATCTGGGAACTACTCACACATTATTA<br>TGGAGAAACTCGAGCTTGT<br>CGATCGACAGATCCGGTCGGCATCTACTtcagacttttctttttttttttggt<br>gctgctg<br>ggactccatggattccatctcctcccaattgtgacaaatcgattcttgtttcatacaatc<br>ctgtgattgattgatggatcaatgttgcatccaagacttcttttgttgatgtatatcttt<br>ttctatcgattgttgtatcgaaatatttgaatgctgctggtgctcccaagtttgtcaatg<br>tgaacaaatggatgatgttttctgcttgttctctgattggtttatctctatgtttgttat |

TABLE 24-continued

Additional Exemplary gene editing plasmids

| SEQ ID NO | Name | Sequence |
|---|---|---|
| | | atgctgacaagactttatccaagtttgcatctgccaagatgactctttttgagaattctg
agatttgttcgatgatttcatccaaataatgtttatgttgttcgacgaacaattgttttt
gttcgttatcttctggtgatcctttcaattttcataatgtgatgccaaatacaagaagt
tgacatattttgatggcaatgccaattcgtttccttttgcaattctcctgctgatgcca
acattcttttcttccgttttccaattcgaacaatgaatattttggcaatttgatgatca
aatcttttttgacttcttttatatccttttgcttccaagaaatcgattgggttttttcga
atgatgatctttccatgattgtgattcccaacaattctttgactgatttcaattttttg
attttccttttcgacttttgcgacgaccaagactgaatatgcgactgttggtgaatcga
atcctccatattttttggatcccaatctttttttcttgcgatcaatttatctgagtttc
tttttggcaagattgattcttttgagaatcctcctgtttggacttctgtttttttgacga
tgttgacttgtggcattgacaagacttttctgactgttgcgaaatctcttcctttatccc
agacgatttctcctgtttctccgtttgtttcgatcaatggtcttttctgatttctccgt
ttgccaatgtgatttctgtttgaagaagttcatgatgtttgaatagaagaaatattttg
ctgttgcttttccgatttcttgttctgattttgcgatcattttctgacatcatagactt
tataatctccatagacgaattctgattccaattttggatattttttgatcaatgctgttc
cgacgactgcgttcaaatatgcatcatgtgcatgatgatagttgttgatttctctgactt
tatagaattggaaatcttttctgaaatctgaaaccaattttgatttcaatgtgatgactt
tgacttctctgatcaatttatcgttttcatcatattttgtgttcattcttgaatccaaga
tttgtgcgacatgttttgtgatttgtcttgtttcgaccaattgtcttttgatgaatcctg
ctttatccaattctgacaatcctcctctttctgcttttgtcaagttatcgaattttcttt
gtgtgatcaattttgcgttcaacaattgtctccaatagtttttcattttttgacgactt
cttctgatgggacgttatctgatttcctctgtttttatctgatcttgtcaagactttgt
tatcgattgaatcatctttcaagaatgattgtgggacgatatgatcgacatcataatctg
acaatctgttgatatccaattcttgatcgacaatatatctcttccgttttgcaaataat
acaaatacaattttcgttttgcaattgtgtgtttcgactggatgttctttcaagattt
gtgatcccaattctttgattccttcttcgattcttttcattctttctcttgagttttttt
gtccttttgtgttgtttggttttctcttgccatttcgatgacgatgttttctggtttat
gtcttcccatgactttgaccaattcatcgacgactttgactgtttgcaagattccttttt
tgattgctggtgatcctgccaagttgcgatatgttcatgcaatgaatctccttgtcctg
agacttgtgcttttgatatcttcttgaatgtcaatgaatcatcatggatcaattgca
tgaagtttctgtttgcgaatccatctgatctcaagaaatccaagattgttttcctgatt
gtttatctctgattccgttgatcaattttcttgacaatcttccccatcctgtatatcttc
ttcttttcaattgtttcatgactttatcatcgaacaaatgtgcatatgttttcaatcttt
cttcgatcatttctctatcttcgaacaatgtcaatgtcaagacgatatcttccaagatat
cttcgttttcttcgttatccaagaaatctttatctttgatgattttcaacaaatcatgat
atgttcccaatgatgcgttgaatctatcttcgactcctgagatttcgactgaatcgaagc
attcgattttttgaaataatcttcttcaattgtttgactgtgacttttctgtttgttt
tgaacaacaaatcgacgattgctttttttttgttctcctgacaagaatgctggttttctca
ttccttctgtgacatatttgactttgtcaattcgttatagactgtgaaatattcataca
acaatgaatgttttggcaagacttttcgtttggcaagttttatcgaagtttgtcattc
tttcgatgaatgattgtgctgatgctcctttatcgacgacttcttcaagttccatggtg
tgattgtttcttctgattttcttgtcatccatgcgaatcttgagtttcctcttgccaatg
gtccgacataatatgggattctgaatgtcaagatttttcgatttttttctctgttatctt
tcaagaatggatagaaatcttcttgtcttctcaagattgcatgcaattctcccaaatgga
tttgatgtgggattgatccgttatcgaatgttctttgttttctcaacaaatcttctctgt
tcaatttgaccaacaattcttctgttccatccattttttccaagattggtttgatgaatt
tatagaattcttcttgtgatgctcctccatcgatatatcctgcatatccgttttttgatt
gatcgaagaagatttctttatattttctggcaattgttgtctgaccaatgctttcaaca
atgtcaaatcttgatgatgttcatcatatcttttgatcattgatgctgacaatggtgctt
ttgtgatttctgtgttgactctcaagatatctgacaacaagattgcatctgacaagtttt
ttgctgccaagaacaaatctgcatattgatctccgatttgtgccaacaagttatccaaat
catcatcatatgtatctttgacaattgcaattttgcatcttctgccaaatcgaagtttg
atttgaagtttggtgtcaatcccaatgacaatgcgatcaagtttccgaacaatccgtttt
ttttttctcctggcaattgtgcgatcaagtttccaatcttcttgattttgacaatcttg
ctgacaagattgcttttgcatcgactcctgatgcgttgattgggttttcttcgaacaatt
ggttatatgtttggaccaattggatgaacaatttatcgacatctgagttatctgggttca
aatctccttcgatcaagaaatgtcctctgaatttgatcatatgtgccaatgccaaataga
tcaatctcaaatctgctttatctgttgaatcgaccaattttttctcaaatgatagattg
ttggatattttcatgatatgcgacttcatcgacgatgtttccgaagattggatgtcttt
catgttttttatcttcttcgaccaagaatgattcttccaatctatggaagaatgaatcat
cgacttttgccatttcgtttgagaagatttcttgcaaatagcagattctgtttttttcttc
ttgtatatcttcttcttgctgttctttcaatcttgttgcttctgctgtttctcctgaat
cgaacaacaatgctccgatcaagtttttttttgattgaatgtctatctgtgtttcccaaga
ctttgaattttttgatgggactttatattcatctgtgatgactgcccatccgactgagt
ttgttccgatatccaatccgattgaatatttttatctgctgctgggactccatggattc
cgacttttcttttttttttggtgctgcttatcatcatcttataatcgatatcat
gatctttataatctccatcatgatctttataatcTTTAACCTACAAGTCGACATC
AGTGA
GCTGCTGGGTGGTATGCAAGCGAGAGACAAACCATggtaccG
GCGATGAGCTTGTTGTGT
GTAGATGGGAGAAAACGGAGATGGTGGATGTGACCGGAA
TTGGGGTTTTTGTACTATCGA
TGTCATCACAAATTATTATCATATCAGATTGCTAACCCCTA
AACACCGAGAACATTCGAG
ACGCGGGAACAGCAGCTCTAGATCCTCAACGCTTATAAAC |

TABLE 24-continued

Additional Exemplary gene editing plasmids

| SEQ ID NO Name | Sequence |
|---|---|
| | TGCTAGCCTGACACAGAATG<br>ACGCAAGCCTCGAAAATGCTCTATTGTTAAAAACGTACTG<br>AACTTTCAATCTACTTGCGG<br>ACCTCTTAATTCTTCTTCGCTACATACACAACCTCATCGCA<br>GACTCTACGCGCATATCCC<br>CACTCATTATCATACCATGCAACTAATTTCATAAAACGCG<br>AGTTCAACGCGATGCCCGCT<br>TTTGCGTCAAAGATCATCGAATAGTTGCTCCCAACGAAAT<br>CGGTGGAAACAACGTCTTCT<br>TCCGTATAGTCGACAATGCCTTTCTCGATGCCCGGGTGTTT<br>ACCGTCGGCTGCGTCTTTC<br>AGAGCTCgcagggtaccaccagtgttgtggcatAAAAAAGCACCGACTC<br>GGTGCCACTTT<br>TTCAAGTTGATAACGGACTAGCCTTATTTTAACTTGCTATT<br>TCTAGCTCTAaaacTCGGA<br>TATGTGTCGTACGACCATTAGCGAATGTATTACCTGAGAC<br>ATCTTTGTTAGGATTTTGAA<br>TATTGTCTGGCCCGCGGGGTATTATTATGTAATCCAACCA<br>AGCCATTGTCTGCTCCCGGC<br>GAAGTCCGGACACGGTTTCAGTGCTACCGCAACCAAAAGC<br>CACCAACATTCCTTGCCTTC<br>TGCTTTCTTCATCAACGGACTACTCCTTCTGACTTCGCCTT<br>TATTATCATGAACTGTGGC<br>ATCTACCTACCCAGAATCACTTGTTCTTGAATTAGTTGCCT<br>TAATAGTAAGCAGGCCACA<br>AGAAGGCTTTTTGGCActgaggtaccaccagtgttgtggcatAAAAAAGC<br>ACCGACTCGG<br>TGCCACTTTTTCAAGTTGATAACGGACTAGCCTTATTTTAA<br>CTTGCTATTTCTAGCTCTA<br>aaacTCGTTTGATGGTACCAGCAACATTAGCGAATGTATTAC<br>CTGAGACATCTTTGTTAG<br>GATTTTGAATATTGTCTGGCCCGCGGGGTATTATTATGTAA<br>TCCAACCAAGCCATTGTCT<br>GCTCCCGGCGAAGTCCGGACACGGTTTCAGTGCTACCGCA<br>ACCAAAAGCCACCAACATTC<br>CTTGCCTTCTGCTTTCTTCATCAACGGACTACTCCTTCTGA<br>CTTCGCCTTTATTATCATG<br>AACTGTGGCATCTACCTACCCAGAATCACTTGTTCTTGAAT<br>TAGTTGCCTTAATAGTAAG<br>CAGGCCACAAGAAGGCTTTTTGGCAagcctgttggtaccagtcgactga<br>atactgttggc<br>tgtggtgagagaaacagagcgtgagctcaaatacacaagtacgaaatcagagttatgaga<br>gaggatttggagaaagaagatcacctgaagatcgtttgcgtcgcgcgaatgagagagacg<br>gcagagaaaacgagaagctttaagaggacgaacaaaaaccctaatgtcactccttttata<br>tagatgagaaatttaggggtttgggctctaatggagctgtctacatgggctttcatttctt<br>tatccagtaaagaaccggtttaacaggttccctggtttatacgtggttttagccggttaa<br>cttacggaatattattttttatcttaagttacacaaattacatcattaatagtaaaacaaa<br>attttatggtgcaatttaagttttatgatgagtgaaattcgaataatatacaaatattt<br>tactgtttaggtttccctaaaacctacttttagatatgtaaattaaacattttttttttt<br>tggttagaaccaagtcagtgatcatagaactcaaaaagctggtgtttcaattggtacaag<br>cattttattgcaagatataaaaattcagaaggacatatccttgatgtatgtacatgaag<br>gaaccgattttgactccaagctacaaagaagaagaagaatgatatacaaagaaaactgca<br>tatcctcaccatgaaattgaaagctagaggaaggggaataacagatactctgcgtagaag<br>agattccatataaaccgataatatcctgagatagcttcctgcaataatcaaatgtttcta<br>cactccgttagatatacactccattgatgttccgtgataacgagtttatgtttgtacaaa<br>agtattttaccttggtgtagtttgcttttctagtacccatgtctaccaaagatcaacaa<br>caaagatattagagattaatgaatttggcagtgtcaaatgcagaaactaaagcatatagt<br>tatgaagttcttgtgcattatctcaaaagtatgtaagagatataagagtatctcataatg<br>ctttacctggaaaattaagcctgaagccaagatcacatgtgcaggaatcatcaagctacc<br>tctaaaaacctgttcattgttaaaggataagagggttggtcttttcaaagctgcatactg<br>aggaaagtaacaatatcgcaacaaaaataaattggtggcgatagtttatcaagcttctac<br>atgcagtaatggtgttcgtgctttaattaaccgaaatagttaagacggaaatagatgaat<br>tcacctgaggcatgtagaaagctagtgatatggctgaaacataatttactagcagaagtc<br>cagaaccgaggaatgcaatgtttctcactccaagtttgttgccagggttgatatttgga<br>acctattcaagatcaatcaaaggcatgattaactaaacatgcttgaacaaacacataaag<br>acaatatatcaaacggagctggttaaacattgtctttgactgtcaaatggattgagccaa<br>agagcggaaagaaatggttatgcgtgcagttacttactttcgatctccttcaacatcag<br>gaaggtcctttgtaatagcaatgaccagtgcaaacagtgtcacaaaagatgtgatgaacg<br>ccacaggtgcactgcaaatagcgaatcaaaagttgagtaatatatctactcacgattatg<br>gaggtggtacctggtgcgatcgctgttggcgcgcgtgtttaattaaggttgcggccgct<br>tacttcgtccgagcctagttcgagccttgacaggatatattggcgggtaaactaagtcgc<br>tgtatgtgtttgtttgagatctcatgtgagcaaaaggccagcaaaaggccaggaaccgta<br>aaaaggccgcgttgctggcgttttccataggctccgcccccctgacgagcatcacaaaa<br>atcgacgctcaagtcagaggtggcgaaacccgacaggactataaagataccaggcgtttc<br>ccccctggaagctccctcgtgcgctctcctgttccgaccctgccgcttaccggatacctgt |

TABLE 24-continued

Additional Exemplary gene editing plasmids

| SEQ ID NO | Name | Sequence |
|---|---|---|
| | | ccgcctttctcccttcgggaagcgtggcgctttctcatagctcacgctgtaggtatctca gttcggtgtaggtcgttcgctccaagctgggctgtgtgcacgaaccccccgttcagcccg accgctgcgccttatccggtaactatcgtcttgagtccaacccggtaagacacgactta cgccactggcagcgccactggtaacaggattagcagagcgaggtatgtaggcggtgcta cagagttcttgaagtggtggcctaactacggctacactagaagaacagtatttggtatct gcgctctgctgaagccagttaccttcggaagaagagttggtagctcttgatccggcaaac aaaccaccgctggtagcggtggttttttttgtttgcaagcagcagattacgcgcagaaaaa aaggatctcaagaagatcctttgatcttttctacggggtctgacgctcagtggaacgaaa actcacgttaagggattttggtcatgagattatcaaaaaggatcttcacctagatcctttt taaattaaaaatgaagttttaaatcaatctaaagtatatatgtgtaacattggtctagtg attatttgccgactaccttggtgatctcgcctttcacgtagtgaacaaattcttccaact gatctgcgcgcgaggccaagcgatcttcttgtccaagataagctgcctagcttcaagta tgacgggctgatactgggccggcaggcgctccattgcccagtcggcagcgacatccttcg gcgcgattttgccggttactgcgctgtaccaaatgcgggacaacgtaagcactacatttc gctcatcgccagcccagtcgggcggcgagttccatagcgttaaggtttcatttagcgcct caaatagatcctgttcaggaaccggatcaaagagttcctcgcgctggacctaccaagg caacgctatgttctcttgcttttgtcagcaagatagccagatcaatgtcgatcgtggctg gctcgaagatacctgcaagaatgtcattgcgctgccattctccaaattg |
| 606 | MG006_ AL056_ pGGZ003_ PsiRg1_ B-dummy_ PsiRg3_ D-dummy_ Cas9_ MGFHyg | cagttcgcgcttagctggataacgccacggaatgatgtcgtcgtgcacaacaatggtgac ttctacagcgcggagaatctcgctctctccaggggaagccgaagtttccaaaaggtcgtt gatcaaagctcgccgcgttgtttcatcaagccttacggtcaccgtaaccagcaaatcaat atcactgtgtggcttcaggccgccatccactgcggagccgtacaaatgtacggccagcaa cgtcggttcgagatggccgctcgatgacgccaactacctctgatagttgagtcgatacttc ggcgataccgcttccctcataacaccccttgtattactgtttatgtaagcagacagttt tattgttcatgatgatatatttttatcttgtgcaatgtaacatcagagattttgagacac aacgtggctttgttgaataaatcgaactttttgctgagttgaaggatcagatcacgcatct tcccgacaacgcagaccgttccgtggcaaagcaaaagttcaaaatcaccaactggtccac ctacaacaaagctctcatcaaccgtggctccctcactttctggctggatgatggggcgat tcaggcgatccccatccaacagcccgccgtcgagcgggcttttttatcccccggaagcctg tggatagagggtagttatccacgtgaaaccgctaatgccccgcaaagccttgattcacgg ggctttccggcccgctccaaaaactatccacgtgaaatcgctaatcagggtacgtgaaat cgctaatcggagtacgtgaaatcgctaataaggtcacgtgaaatcgctaatcaaaaaggc acgtgagaacgctaatagccctttcagatcaacagcttgcaaacaccctcgctccggca agtagttacagcaagtagtatgttcaattagcttttcaattatgaatatatatatcaatt attggtcgcccttggcttgtggacaatgcgctacgcgcaccggctccgcccgtggacaac cgcaagcggttgcccaccgtcgagcgccttgcccacaaccgggcggccgccgcaacag atcgttttataaattttttttttgaaaaagaaaaagcccgaaaggcggcaacctctcgg gcttctggatttccgatccccggaattagatcttggcaggatatattgtggtgtaacgtt ggatctggctgagaacgccagctgtgcatgcttggtctagaatacGATCTGGATTTTA GT<br>ACTGGATTTTGGTTTTAGGAATTAGAAATTTTATTGATAGA<br>AGTATTTTACAAATACAAA<br>TACATACTAAGGGTTTCTTATATGCTCAACACATGAGCGA<br>AACCCTATAGGAACCCTAAT<br>TCCCTTATCTGGGAACTACTCACACATTATTATGGAGAAA<br>CTCGAGCTTGTCGATCGACA<br>GATCCGGTCGGCATCTACTCTATTTCTTTGCCCTCGGACGA<br>GTGCTGGGGCGTCGGTTTC<br>CACTATCGGCGAGTACTTCTACACAGCCATCGGTCCAGAC<br>GGCCGCGCTTCTGCGGGCGA<br>TTTGTGTACGCCCGACAGTCCCGGCTCCGGATCGGACGAT<br>TGCGTCGCATCGACCCTGCG<br>CCCAAGCTGCATCATCGAAATTGCCGTCAACCAAGCTCTG<br>ATAGAGTTGGTCAAGACCAA<br>TGCGGAGCATATACGCCCGGAGTCGTGGCGATCCTGCAAG<br>CTCCGGATGCCTCCGCTCGA<br>AGTAGCGCGTCTGCTGCTCCATACAAGCCAACCACGGCCT<br>CCAGAAGAAGATGTTGGCGA<br>CCTCGTATTGGGAATCCCCGAACATCGCCTCGCTCCAGTC<br>AATGACCGCTGTTATGCGGC<br>CATTGTCCGTCAGGACATTGTTGGAGCCGAAATCCGCGTG<br>CACGAGGTGCCGGACTTCGG<br>GCAGTCCTCGGCCCAAAGCATCAGCTCATCGAGAGCCTG<br>CGCGACGGACGCACTGACGG<br>TGTCGTCCATCACAGTTTGCCAGTGATACACATGGGGATC<br>AGCAATCGCGCATATGAAAT<br>CACGCCATGTAGTGTATTGACCGATTCCTTGCGGTCCGAA<br>TGGGCCGAACCCGCTCGTCT<br>GGCTAAGATCGGCCGCAGCGATCGCATCCATAGCCTCCGC<br>GACCGGTTGTAGAACAGCGG<br>GCAGTTCGGTTTCAGGCAGGTCTTGCAACGTGACACCCTG<br>TGCACGGCGGGAGATGCAAT<br>AGGTCAGGCTCTCGCTAAACTCCCCAATGTCAAGCACTTC<br>CGGAATCGGGAGCGCGGCCG |

TABLE 24-continued

Additional Exemplary gene editing plasmids

| SEQ ID NO Name | Sequence |
|---|---|
| | ATGCAAAGTGCCGATAAACATAACGATCTTTGTAGAAACC |
| | ATCGGCGCAGCTATTTACCC |
| | GCAGGACATATCCACGCCCTCCTACATCGAAGCTGAAAGC |
| | ACGAGATTCTTCGCCCTCCG |
| | AGAGCTGCATCAGGTCGGAGACGCTGTCGAACTTTTCGAT |
| | CAGAAACTTCTCGACAGACG |
| | TCGCGGTGAGTTCAGGCTTTTTCATATCTCATTGCCCCCCG |
| | GGATCTGCGAAAGCTCGAG |
| | AGAGATAGATTTGTAGAGAGAGACTGGTGATTTCAGCGTG |
| | TCCTCTCCAAATGAAATGAA |
| | CTTCCTTATATAGAGGAAGGTCTTGCGAAGGATAGTGGGA |
| | TTGTGCGTCATCCCTTACGT |
| | CAGTGGAGATATCACATCAATCCACTTGCTTTGAAGACGT |
| | GGTTGGAACGTCTTCTTTTT |
| | CCACGATGCTCCTCGTGGGTGGGGGTCCATCTTTGGGACC |
| | ACTGTCGGCAGAGGCATCTT |
| | GAACGATAGCCTTTCCTTTATCGCAATGATGGCATTTGTA |
| | GGTGCCACCTTCCTTTTCTA |
| | CTGTCCTTTTGATGAAGTGACAGATAGCTGGGCAATGGAA |
| | TCCGAGGAGGTTTCCCGATA |
| | TTACCCTTTGTTGAAAAGTCTCAATAGCCCTTTGGTCTTCT |
| | GAGACTGTATCTTTGATAT |
| | TCTTGGAGTAGACGAGAGTGTCGTGCTCCACCATGTTATC |
| | ACATCAATCCACTTGCTTTG |
| | AAGACGTGGTTGGAACGTCTTCTTTTTCCACGATGCTCCTC |
| | GTGGGTGGGGGTCCATCTT |
| | TGGGACCACTGTCGGCAGAGGCATCTTGAACGATAGCCTT |
| | TCCTTTATCGCAATGATGGC |
| | ATTTGTAGGTGCCACCTTCCTTTTCTACTGTCCTTTTGATG |
| | AAGTGACAGATAGCTGGGC |
| | AATGGAATCCGAGGAGGTTTCCCGATATTACCCTTTGTTG |
| | AAAAGTCTCAtagtGATCTG |
| | GATTTTAGTACTGGATTTTGGTTTTAGGAATTAGAAATTTT |
| | ATTGATAGAAGTATTTTAC |
| | AAATACAAATACATACTAAGGGTTTCTTATATGCTCAACA |
| | CATGAGCGAAACCCTATAGG |
| | AACCCTAATTCCCTTATCTGGGAACTACTCACACATTATTA |
| | TGGAGAAACTCGAGCTTGT |
| | CGATCGACAGATCCGGTCGGCATCTACTtcagacttttctttttttttttggt |
| | gctgctg |
| | ggactccatggattccatctcctcccaattgtgacaaatcgattcttgtttcatacaatc |
| | ctgtgattgattgatggatcaatgttgcatccaagacttcttttgttgatgtatatctttt |
| | ttctatcgattgttgtatcgaaatatttgaatgctgctggtgctcccaagtttgtcaatg |
| | tgaacaaatggatgatgttttctgcttgttctctgattggtttatctctatgtttgttat |
| | atgctgacaagacttatccaagtttgcatctgccaagatgactcttttgagaattctg |
| | agatttgttcgatgatttcatccaaataatgtttatgttgttcgacgaacaattgttttt |
| | gttcgttatcttctggtgatcctttcaattttcataatgtgatgccaaatacaagaagt |
| | tgacatattttgatggcaatgccaattcgtttccttttgcaattctcctgctgatgcca |
| | acattcttttcttccgttttccaattcgaacaatgaatattttggcaatttgatgatca |
| | aatcttttttgacttctttatatccttttgcttccaagaaatcgattgggttttttttcga |
| | atgatgatctttccatgattgtgattcccaacaattctttgactgatttcaatttttttg |
| | attttcctttttcgacttttgcgacgaccaagactgaatatgcgactgttggtgaatcga |
| | atcctccatatttttttggatcccaatctttttttcttgcgatcaatttatctgagtttc |
| | tttttggcaagattgattcttttgagaatcctcctgtttggacttctgtttttttgacga |
| | tgttgacttgtggcattgacaagacttttctgactgttgcgaaatctcttcctttatccc |
| | agacgatttctcctgtttctccgtttgtttcgatcaatggtctttttctgatttctccgt |
| | ttgccaatgtgatttctgtttgaagaagttcatgatgtttgaatagaagaaatattttg |
| | ctgttgcttttccgatttcttgttctgattttgcgatcattttctgacatcatagactt |
| | tataatctccatagacgaattctgattccaattttggatattttttgatcaatgctgttc |
| | cgacgactgcgttcaaatatgcatcatgtgcatgatgatagttgttgatttctctgactt |
| | tatagaattggaaatctttctgaaatctgaaccaattttgatttcaatgtgatgactt |
| | tgacttctctgatcaatttatcgttttcatcatattttgtgttcattcttgaatccaaga |
| | tttgtgcgacatgttttgtgatttgtcttgtttcgaccaattgtcttttgatgaatcctg |
| | ctttatccaattctgacaatcctcctctttctgcttttgtcaagttatcgaattttcttt |
| | gtgtgatcaatttgcgttcaacaattgtctccaatagttttcattttttttgacgactt |
| | cttctgatgggacgttatctgatttcctctgtttttatctgatcttgtcaagacttgt |
| | tatcgattgaatcatctttcaagaatgattgtgggacgatatgatcgacatcataatctg |
| | acaatctgttgatatccaattcttgatcgacatacatatctcttccgttttgcaaataat |
| | acaaatacaattttcgtttgcaattgtgtgttttcgactggatgttctttcaagattt |
| | gtgatcccaattctttgattccttcttcgattcttttcattcttctcttgagttttttt |
| | gtcctttttgtgttgtttggttttctcttgccatttcgatgacgatgttttctggtttat |
| | gtcttcccatgactttgaccaattcatcgacgactttgactgtttgcaagattccttttt |
| | tgattgctggtgatcctgccaagtttgcgatatgttcatgcaatgaatctccttgtcctg |
| | agacttgtgcttttggatatcttctttgaatgtcaatgaatcatcatggatcaattgca |
| | tgaagtttctgtttgcgaatccatctgatttcaagaaatccaagattgttttttcctgatt |

TABLE 24-continued

Additional Exemplary gene editing plasmids

| SEQ ID NO Name | Sequence |
|---|---|
| | gtttatctctgattccgttgatcaattttcttgacaatcttccccatcctgtatatcttc<br>ttcttttcaattgtttcatgactttatcatcgaacaaatgtgcatatgttttcaatcttt<br>cttcgatcatttctctatcttcgaacaatgtcaatgtcaagacgatatcttccaagatat<br>cttcgttttcttcgttatccaagaaatctttatctttgatgattttcaacaaatcatgat<br>atgttcccaatgatgcgttgaatctatcttcgactcctgagatttcgactgaatcgaagc<br>attcgatttttttgaaataatcttctttcaattgtttgactgtgacttttctgtttgttt<br>tgaacaacaaatcgacgattgcttttttttgttctcctgacaagaatgctggttttctca<br>ttccttctgtgacatatttgactttgtcaattcgttatagactgtgaaatattcataca<br>acaatgaatgttttggcaagacttttcgtttggcaagttttatcgaagtttgtcattc<br>tttcgatgaatgattgtgctgatgctcctttatcgacgacttcttcgaagttccatggtg<br>tgattgtttcttctgattttcttgtcatccatgcgaatcttgagtttcctcttgccaatg<br>gtccgacataatatgggattctgaatgtcaagattttttcgattttttctctgttatctt<br>tcaagaatggatagaaatcttcttgtcttctcaagattgcatgcaattctcccaaatgga<br>tttgatgtgggattgatccgttatcgaatgttctttgttttctcaacaaatcttctctgt<br>tcaatttgaccaacaattcttctgttccatccattttttccaagattggtttgatgaatt<br>tatagaattcttcttgtgatgctcctccatcgatatatcctgcatatccgttttttgatt<br>gatcgaagaagatttctttatattttctggcaattgttgtctgaccaatgctttcaaca<br>atgtcaaatcttgatgatgttcatcatatcttttgatcattgatgctgacaatggtgctt<br>ttgtgatttctgtgttgactctcaagatatctgacaacaagattgcatctgacaagtttt<br>ttgctgccaagaacaaatctgcatattgatctccgatttgtgccaacaagttatccaaat<br>catcatcatatgtatctttgacaattgcaattttgcatcttctgccaaatcgaagtttg<br>atttgaagtttggtgtcaatcccaatgacaatgcgatcaagtttcgaacaatccgtttt<br>ttttttctcctggcaattgtgcgatcaagttttccaatcttcttgattttgacaatcttg<br>ctgacaagattgcttttgcatcgactcctgatgcgttgattgggttttcttcgaacaatt<br>ggttatatgtttggaccaattggatgaacaatttatcgacatctgagttatctgggttca<br>aatctccttcgatcaagaaatgtcctctgaatttgatcatatgtgccaatgccaaataga<br>tcaatctcaaatctgctttatctgttgaatcgaccaatttttttctcaaatgatagattg<br>ttggatatttttcatgatatgcgacttcatcgacgatgtttccgaagattggatgtcttt<br>catgtttttatcttcttcgaccaagaatgattcttccaatctatggaagaatgaatcat<br>cgacttttgccatttcgtttgagaagatttcttgcaaatagcagattctgttttttcttc<br>ttgtatatcttcttcttgctgttcttttcaatcttgttgcttctgctgtttctcctgaat<br>cgaacaacaatgctccgatcaagttttttttgattgaatgtctatctgtgtttcccaaga<br>ctttgaattttttgatgggactttatattcatctgtgatgactgcccatccgactgagt<br>tgttccgatatccaatccgattgaatatttttatctgctgctgggactccatggattc<br>cgacttttcttttttttttggtgctgctttatcatcatcatctttataatcgatatcat<br>gatctttataatctccatcatgatctttataatcTTTAACCTACAAGTCGACATC<br>AGTGA<br>GCTGCTGGGTGGTATGCAAGCGAGAGACAAACCATggtaccG<br>GCGATGAGCTTGTTGTGT<br>GTAGATGGGAGAAAACGGAGATGGTGGATGTGACCGGAA<br>TTGGGGTTTTTGTACTATCGA<br>TGTCATCACAAATTATTATCATATCAGATTGCTAACCCCTA<br>AACACCGAGAACATTCGAG<br>ACGCGGGAACAGCAGCTCTAGATCCTCAACGCTTATAAAC<br>TGCTAGCCTGACACAGAATG<br>ACGCAAGCCTCGAAAATGCTCTATTGTTAAAAACGTACTG<br>AACTTTCAATCTACTTGCGG<br>ACCTCTTAATTCTTCTTCGCTACATACACAACCTCATCGCA<br>GACTCTACGCGCATATCCC<br>CACTCATTATCATACCATGCAACTAATTTCATAAAACGCG<br>AGTTCAACGCGATGCCCGCT<br>TTTGCGTCAAAGATCATCGAATAGTTGCTCCCAACGAAAT<br>CGGTGGAAACAACGTCTTCT<br>TCCGTATAGTCGACAATGCCTTTCTCGATGCCCGGGTGTTT<br>ACCGTCGGCTGCGTCTTTC<br>AGAGCTCgcagggtaccaatttacagggaatgaaggtaaaggttatctaggatccacctg<br>aggtaccaccagtgttgtggcatAAAAAAGCACCGACTCGGTGCCACTT<br>TTTCAAGTTGA<br>TAACGGACTAGCCTTATTTTAACTTGCTATTTCTAGCTCTA<br>aaacCGGGGATGTGTGGAC<br>GGGCCcATTAGCGAATGTATTACCTGAGACATCTTTGTTAG<br>GATTTTGAATATTGTCTGG<br>CCCGCGGGGTATTATTATGTAATCCAACCAAGCCATTGTC<br>TGCTCCCGGCGAAGTCCGGA<br>CACGGTTTCAGTGCTACCGCAACCAAAAGCCACCAACATT<br>CCTTGCCTTCTGCTTTCTTC<br>ATCAACGGACTACTCCTTCTGACTTCGCCTTTATTATCATG<br>AACTGTGGCATCTACCTAC<br>CCAGAATCACTTGTTCTTGAATTAGTTGCCTTAATAGTAAG<br>CAGGCCACAAGAAGGCTTT<br>TTGGCAagcctgttggtaccagtcgactgaatactgttggtaccaccagtgttgtggcat<br>AAAAAAGCACCGACTCGGTGCCACTTTTTCAAGTTGATAA<br>CGGACTAGCCTTATTTTAAC<br>TTGCTATTTCTAGCTCTAaaacCTGAGCTGCATTCCAGCAATc<br>ATTAGCGAATGTATTAC |

TABLE 24-continued

Additional Exemplary gene editing plasmids

| SEQ ID NO | Name | Sequence |
|---|---|---|
| | | CTGAGACATCTTTGTTAGGATTTTGAATATTGTCTGGCCCG<br>CGGGGTATTATTATGTAAT<br>CCAACCAAGCCATTGTCTGCTCCCGGCGAAGTCCGGACAC<br>GGTTTCAGTGCTACCGCAAC<br>CAAAAGCCACCAACATTCCTTGCCTTCTGCTTTCTTCATCA<br>ACGGACTACTCCTTCTGAC<br>TTCGCCTTTATTATCATGAACTGTGGCATCTACCTACCCAG<br>AATCACTTGTTCTTGAATT<br>AGTTGCCTTAATAGTAAGCAGGCCACAAGAAGGCTTTTTG<br>GCAaggtggtacctggtgcg<br>atcgctgttggcgcgccgtgtttaattaaggttgcggccgcttacttcgtccgagcctag<br>ttcgagccttgacaggatatattggcgggtaaactaagtcgctgtatgtgtttgtttgag<br>atctcatgtgagcaaaaggccagcaaaaggccaggaaccgtaaaaaggccgcgttgctgg<br>cgttttccataggctccgcccccctgacgagcatcacaaaaatcgacgctcaagtcaga<br>ggtggcgaaacccgacaggactataaagataccaggcgtttccccctggaagctccctcg<br>tgcgctctcctgttccgaccctgccgcttaccggatacctgtccgcctttctcccttcgg<br>gaagcgtggcgctttctcatagctcacgctgtaggtatctcagttcggtgtaggtcgttc<br>gctccaagctgggctgtgtgcacgaaccccccgttcagcccgaccgctgcgccttatccg<br>gtaactatcgtcttgagtccaacccggtaagacacgacttatcgccactggcagcagcca<br>ctggtaacaggattagcagagcgaggtatgtaggcggtgctacagagttcttgaagtggt<br>ggcctaactacggctacactagaagaacagtatttggtatctgcgctctgctgaagccag<br>ttaccttcggaagaagagttggtagctcttgatccggcaaacaaaccaccgctggtagcg<br>gtggtttttttgtttgcaagcagcagattacgcgcagaaaaaaaggatctcaagaagatc<br>ctttgatcttttctacggggtctgacgctcagtggaacgaaaactcacgttaagggattt<br>tggtcatgagattatcaaaaaggatcttcacctagatccttttaaattaaaaatgaagtt<br>ttaaatcaatctaaagtatatatgtgtaacattggtctagtgattatttgccgactacct<br>tggtgatctcgcctttcacgtagtgaacaaattcttccaactgatctgcgcgcgaggcca<br>agcgatcttcttgtccaagataagcctgcctagcttcaagtatgacgggctgatactggg<br>ccggcaggcgctccattgcccagtcggcagcgacatccttcggcgcgattttgccggtta<br>ctgcgctgtaccaaatgcgggacaacgtaagcactacatttcgctcatcgccagcccagt<br>cgggcggcgagttccatagcgttaaggtttcatttagcgcctcaaatagatcctgttcag<br>gaaccggatcaaagagttcctccgccgctggacctaccaaggcaacgctatgttctcttg<br>cttttgtcagcaagatagccagatcaatgtcgatcgtggctggctcgaagatacctgcaa<br>gaatgtcattgcgctgccattctccaaattg |

A genetic modification can involve the upregulated expression of PsiR. An analysis of PsiD, PsiM, PsiT2, PsiH, PsiK, PsiT1, PsiP, and PsiL reveals that PsiD, PsiH, PsiM, PsiT2 genes contain one E-box motif in their promoters (PsiT1 has two), whereas PsiP contains 4 E-box motifs (500 bp upstream of ATG). PsiL and PsiK do not have E-box motif, or E-box motifs in their upstream regions. Thus, upregulating PsiR is expected to modulate expression of the Psi genes thereby enhancing production of one or more alkaloids.

Listed below are regulatory sequences of PsiD, PsiM, PsiT2, PsiH, PsiK, PsiT1, PsiP, and PsiL.

Listed below in TABLE 25 are regulatory sequences of PsiD, PsiM, PsiT2, PsiH, PsiK, PsiT1, PsiP, and PsiL.

TABLE 25

Psilocybe cubensis Regulatory Gene Sequences

| SEQ ID NO | Name | Sequence |
|---|---|---|
| 713 | PsiD_Psilocybe cubensis (v1, unmasked) | ATTGGCTAGGTTCTCCAATTTCATTCGTCAGGTATGAC<br>CTGGGTATGACCGACCTGTTCAATTCTCGTAATTGATA<br>TTTCAACAATTCCTCTTAGATATCCATCTCTGAGATTG<br>GTAAGGAGTATCACGACAGGCCTAACACTAGATCACC<br>TTTCCTACCTTCCATGCACGCTTACATCTCATGCTTGC<br>TGTAGTAAAGAAGAGGTCGTGTGCCACATTGCTCGAA<br>CAAAGCATGCATTACGTCAATACCACTGGATTAGGTT<br>GAAGAACCGGCGATCTGGGCAGACGCGCCACGCTCTG<br>AGTACCTAAGGGTGTACTTAAATTTATCACAGCTTGAC<br>GTTTGACCTGGAAGCTTGATTTACGCAAGGTTGGAAC<br>TTGCACCCCCCGGTCGAGCATCTCTCTCTAGTCATAGT<br>TTATCTTTGTATAAATGGGGGCCTCAACGCAAGGCCG<br>CAAAACTACTCCCAACTTTTATAACTCATTTCTGCTCC<br>CAACACTTGATC |
| 714 | PsiM_Psilocybe cubensis (v1, unmasked) | AAGCGATCCAAACTGAAGCGACGCCGGACGCGAATG<br>TAATGCAAAGACTTTCTTCCTTTGACCCAATTGGGCTT<br>TTCCCTTTGTGTCTAATCGGATACTTTAAAGTCAATTA<br>TCTCATCATGCCACTGCTCTTATCTAACATTAGTCCTT<br>CACCTTCAATTCAATGACGGCCTTTCCTTTGAGAAGAT<br>CGAATATCGGTGAATACATACCTTCAGCAGCGTGGC<br>GATTCATAATAAGTGTACTCAAAGGGTCCTTCTATTTA |

TABLE 25-continued

*Psilocybe cubensis* Regulatory Gene Sequences

| SEQ ID NO | Name | Sequence |
|---|---|---|
| | | ACAGGTATTATTATGACGGCGAATATGAAAACGTAAA ACAATGTAACCCCCTGCATGAGATGATATCATATCAC GCATGATCCTCATGCCTGAAAAGATTGTGTACACGTT GCGAACAGATTAGATTGTACCCCACGATGGTCGACTT CTATACTAACTGATAGATACATAAGGCTAGTGTCCTG AAGGTCAAGACCAGTAGCTCTCCCCTCATCCTGTCATC CAAAATACACCGCT |
| 715 | PsiT2_*Psilocybe cubensis* (v1, unmasked) | GCGCAAGAAGCTATTACTGTAGTGTCGATAGGACATG GTTGACCTTCGTTCGACGCGACGTACTGGCTAATATTC ATTAGCGCCGCCCGCTCCATGAGTAATGGAATCCGAT TTGCTCGCACAAGTAATGATGCATCTGTCGTCATACTA CCCAAAATCCTTGTTCGGAGAAAACGGGAACCGACGA ACTTCAAGATGGGCAAGGAAAAGGCAGTGACAGCCG GATCGCAAGATACAAGTCCGATGGAGTTTTTAAACCG GAGTCGATGCCCAGCCAATAATATTGCATGATAGCCG ATATGCCGAGTGATGCCATCACCAATTTTGTCCTTTTC GGGTTAGATCTATAGGGGCAAACAGGGACAATTCAAA AGACCCACCCACGCCGAAAATGCCCAGAGCTTCTTA ATGACAACTAATTAAAGATTTGCATTTAGCCAGCGAG ACTCTGACGAAATTCGGAGCTCTTTTCCCCTCTCTTGA ACCATCCCCTTACCCT |
| 716 | PsiH_*Psilocybe cubensis* (v1, unmasked) | CGCCAAAGTCACTGCAGGTATTGCTGCTCATATTGTG ATGTGGACCGACTTTATGCAGTGGGGAGCGAGGAAG AAAGGATAAATTTTGTGAAAAAGGGGGTAGCTGCCTT TCACGACGCCAGGGGCAACAACGACAATGGGGAAAT TACGTCTACCTTACTGAAGGAATCATCCACTGCGTAAT GTAGCTGTTCATACATGTATAATGCAAATTTTGTAGAA GTGCTCGTGCTCGTCTATTACTAGTACTACCTGACTCT AAAGTGGGGAGATCAGAGGGTGGACGAGAGCATTTC CATCTGGATAGTTAAAAGAACACCCATACGTCAGCTC GACCGAACAAGATCATTTCTAGATCTAATTTTGGAAC GAAGAGTGGGGCTTAAAAGGGACAAAGAAGATAATG TTCGGCTTTGCACAATGCCTATTCGCCTCGAGGTTCGT CACGTTTATTGGTTAAAAGAATCCGTCGCTGAGGCTC ACTGGGCATCTCCCCATC |
| 717 | PsiK_*Psilocybe cubensis* (v1, unmasked) | TTAGTGGACAAAACATCATGCTAAAATGGATCTCACA CTGATTGGTTTTGGCACCCTTCTCTTGCGTAATGCATC GCCTGACACAGGGATTGTAGTACGCGACCTGGCAGTT CCAAATTTTGGTTAGTCTTGAACCTTGCCATGATTTGC CTTAGCTACCTTCCGGGAAGTTATCTGGCCGTAGCTTC TCCGCAGCGTGCCTTAAAGGCTTCCAATTAAAGGAAT ATTCCATCATCCTGAGTATCTAAAACTCGAAGATAAG GAAATGCTAAATGGTTGACTTAGTTTAACAGTGTAGT ATACTTGATTTATGTACGGTATGTTTTTTGCTCGGCGA TGTAATCGCACGGCGTTACGTGCTACGTCGATGTTGAT GAGCTGCTTTTGCGCATCGTTCCAAAAATAGACTTAAT CTTAAGTACTTAGCCCAGCGAGTTCAAATTGAAAAGT GAGCGACTCTCCTCGGTTCCCCCTTCTTAAGAGCTTTA ACTTCTCTTACT |
| 718 | PsiT1_*Psilocybe cubensis* (v1, unmasked) | GCACACCAAGCCGAGTAATGAGGTAGGCTATTTGAAG AGATTTGAAGGCCCATAAAGAGTTGGGGGTAATTTTA CACAGTATTAAGCAAGCATGAAAGCAGTGCCATCAGA AAAAGGTTGTTGTTTGCTGATAACGTAATCGTTACCTG TCATCACACTTCGTTGAATTTTAGCGAGACCACATTTT TCTTTTAACAACGACGGTCAACATTGACATTAGAAAA CCATAAATTGTTCCTCATTTCACTTTCAAGCTTTTCTGA GATCAAATAGTTCATTCAATCACAGCTTTTCATGCATT GAAGGTTTTGAGCACAATCGACGTTTCAATGGGGTC GCTGCGCGTATACATGTGGTCACTTTTGATGCGCATTC TAATGGTCAGCAAGTTTTCCATATGTTATGAAAAAGA ATAAGCGAGGTATAGGTATGTTGATGCCTCTTATATA ACGTACGCTCACTTAGTAAAGTTGTCATCGCTTTCCGA CAGTGCTCTTTA |
| 719 | PsiR_*Psilocybe cubensis* (v1, unmasked) | TATGTACCCTTTATGTTTCTGCTCGGCGAGGAGAACAA AGGCAGACACAATAGACCGGCATTTCGGGCCGATGTT TGTTCCAGATATTGCAGCCGGAACAATGCCGTGGTGG CGTGGGAACTCGTGATCTGTTGATAGTCTGACCGCCA GGTCACAGGGTTTCTGATCACGACAGTCGTGACTTTC ACGCCCCATTCCCCCCAATATCCCCCCTGCCCCTGC CTCCAGAGCCGTCCCCTCCGGATCTCTCTTCTAGGTCCC CATTCTGAAGGTGAATCCTCATAGCTGACCCCAGTGC |

TABLE 25-continued

Psilocybe cubensis Regulatory Gene Sequences

| SEQ ID NO | Name | Sequence |
|---|---|---|
| | | GAGCACGTTCCAACTTTCCGCTTTTTCTAGCCCAAAT<br>ATCAACCAAGCAAGACCCGGGGCATCCTCCATATCTC<br>CCCCCAACGGCGCCAAAGTCCAGTCTTCAGGCCTAAA<br>GCCTCCCAATAGTCGACACCCTATCTGACAACGGGCC<br>CATAACCCCCAGATAAACTCTTTTATCAAGAAAGTCA<br>ACCCATCTGCGCTCC |
| 720 | PsiP_Psilocybe cubensis (v1, unmasked) | CGTTTCGGCGCTGCAATGTCACCTAATGATCTAACGA<br>CTACGTTTCTTTGCTCATTGTGATTTGGCACTTAATAA<br>TGCTCCAACCGTGCTATCGAATCATGACAGGCAAATC<br>AATACAGATGGATTCTTTTGGTATTCAAGCACAGGCA<br>GAATCAAACATGGTTATTAGACTTCAATAATCTGAAG<br>TCGTGTGATATGAGCATGGTTCTGGACGTTCTTTATTG<br>GCTCAGAATACCGGCACTAAAGCCGCTCAATCTATAA<br>TTAACGAGTCTAAACCATGAAAGTTGTTTAGCTTGTCG<br>CTATAATTAATGGAAGTGACATTCACTATGCTTACGAT<br>GCACATCATCTTAGATCTATTCTTCTGCACGTAACATA<br>CAGCAGCCAGGCGACCGATGCCCTCCCCCGCCGGGCT<br>GGGAGAAGCACTGCAGGATGCAAATACTTAAATACGG<br>GGTAGGATGTACATCGAGAGGTTAACGCTCAGTCCCA<br>GGGCCTTCGTTCAAT |
| 721 | PsiL_Psilocybe cubensis (v1, unmasked) | TAAAGGTCAAGAGGTTATTTTGGACACCTGAGAGTCA<br>AGGAAGGTAGATTATGCCTGCAATACATGTTTACATTT<br>AAAAACTAGAAGAAAGTAAGATTGCGATTGGGTGTAA<br>AAAAGCTTGATGTAATACTGGAATAGCCTGAATACTT<br>GTTAAAGGGTGAGCAGCAAGGCGTTGTGTATAACTAA<br>AGTTCAAGTCATGAGTAAAGGAGCTCAGAATCGCATT<br>ATACTTACCTAGTCAGACAAAAGTTGTAGGTGAACTG<br>TAATTGCGATCAAGAACTGAAGCAAATTAAAGAACAA<br>GGGGGAAAAGAAGGTACACTCATACCAACTCAAGTC<br>AAAGTACCGATACATCGTTGCTATTCATACCAATGTTC<br>CGCTGAAGCCATGAAGAAGATCGGTCATTAAATGTGC<br>CGTTGTGCCTAGACCCCAATTCTCGTTAAACTGCCTGG<br>TAGTATACTCGTATAAAAGACTTGCTTCAAAGATGTTC<br>CTTTGCAAGTTTCAAG |

In silico analysis of PsiR expression levels and splice forms was performed using a publicly available database.

Primers used to validate PsiR splice variants were as follows:

| PsiR_F1 | AACTCACGATCCTGCCTTG<br>(SEQ ID NO: 677) |
|---|---|
| PsiR_R1 | ACTGGGTACAATGCGGC<br>(SEQ ID NO: 678) |

In particular, disclosed is a CRISPR vector toolkit for making one or more genetic modifications to an organism. In some embodiments, the organism is a fungal organism. The fungal organism can be a fungal protoplast. The CRISPR vector toolkit includes 6 entry vectors (pMGA, pMGB, pMGC, pMGD, pMGE, pMGF). The backbone of the vectors can be a commercially available vector, pUC57. Exemplary vector sequences are shown in TABLE 24 below with vector names shown in parenthesis.

Figure 4:
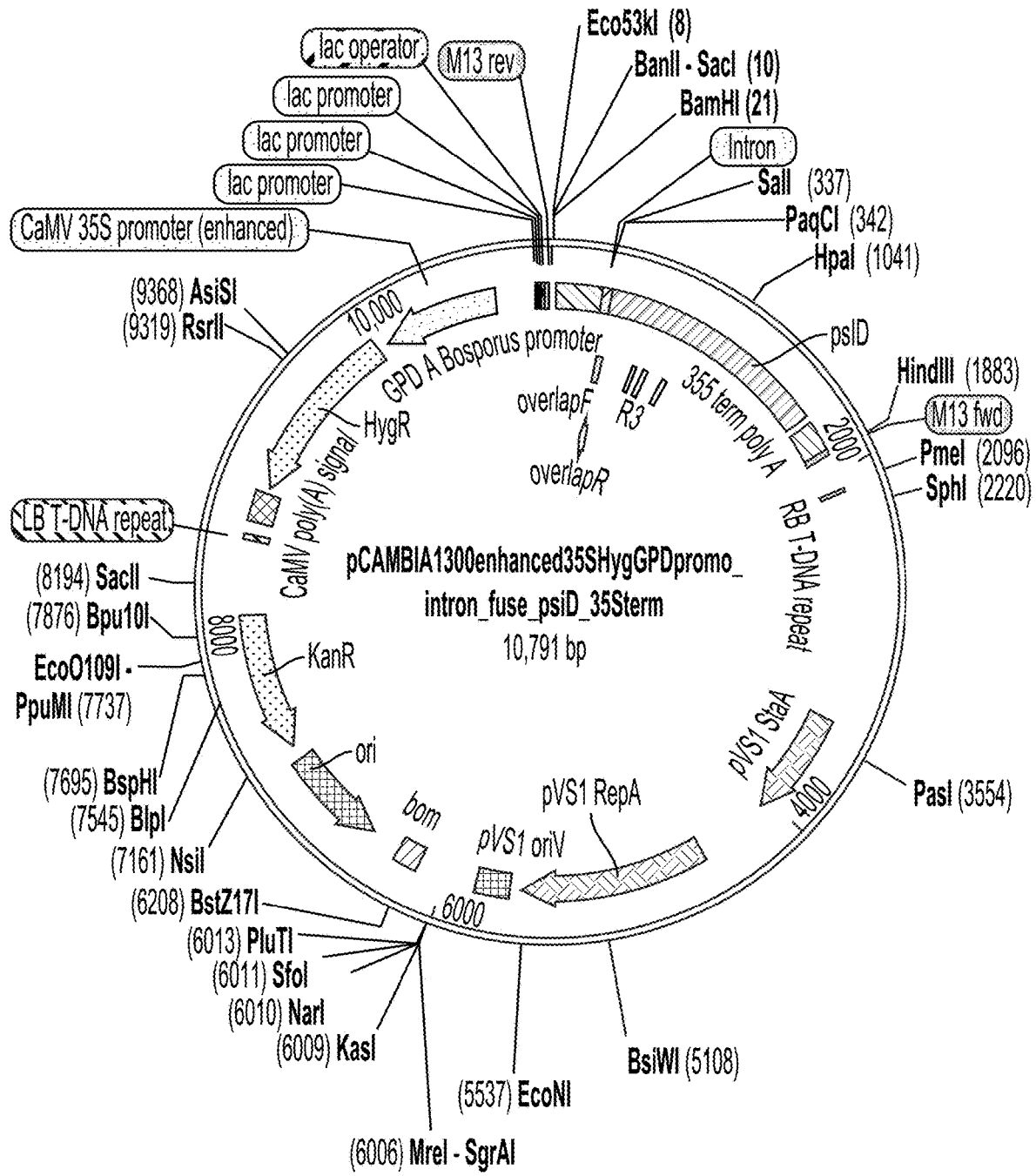
FIG. 4 shows a plasmid encoding PsiD.

Making reference to FIG. 4, vectors pMGA, B, C and D can be used to clone gRNAs directly downstream of a *Psilocybe cubensis* U6 promoter. Exemplary U6 promoters are described below. Vector pMGE can consist of a strong promoter driving a *Psilocybe cubensis* codon optimized Cas9 gene or the nickase variant (D10A, nCas9). TABLE 28 shows optimal codons for designing Cas endonucleases, and NLS sequences for use in *Psilocybe cubensis*. Such codon optimization can be used to improve gene expression and increase the translational efficiency of the Cas9 by accommodating codon bias of the fungal cell. The *Psilocybe cubensis* codon optimized Cas9 gene may comprise a sequence that is at least: 75 percent, 80 percent, 85 percent, 90 percent, 95 percent, 99 percent, or 100 percent identical to SEQ ID NO.: 203, which can achieve high expression and translation efficiency in fungal cells.

Vector pMGF can consist of a strong promoter driving a hygromycin resistance gene. The hygromycin resistance gene is useful during selection. Vectors PMGA, B, C, D, E and F can be assembled together into a binary destination vector (pMGZ) flanked by a left and right border suitable for *agrobacterium*-mediated *Psilocybe cubensis* transformation. An *agrobacterium* can be used to integrate the plasmid system into a fungal cell. In other instances, the Vectors PMGA, B, C, D, E and F can be integrated into a commercial plasmid (e.g., pUC57 or a viral plasmid) and delivered into a fungal cell without *agrobacterium*.

Vectors, pMGA, B, C and D can be used to clone guide RNAs of interest. The guide RNAs can be inserted directly downstream of a *Psilocybe cubensis* U6 promoter and directly upstream of a guide RNA scaffold sequence, see below. The guide RNA of interest may comprise a sequence that binds with an alkaloid synthase gene. The following elements can be part of the pMGA, B, C and D vectors: BsaI site (forward orientation), Overhang 1 for assembly in destination vector, U6 promoter, Overhang A for gRNA insertion, BbsI site (reverse orientation), ccdb negative selection marker, BbsI site (forward orientation), Overhang B for gRNA insertion, Guide RNA scaffold sequence, U6 terminator, Overhang 2 for assembly in destination vector, and BsaI site (reverse orientation). The BsaI site can comprise sequence GGTCTC (forward, 5'→3' orientation) and sequence GAGACC (reverse, 5'→3' orientation). Exemplary pMGA, B, C, and D plasmid sequences are provided in TABLE 24 and TABLE 25.

The pMGA, B, C and D vectors may be identical with the exception of the overhangs for assembly in destination vector. Overhang sequences used to produce the vectors is described in TABLE 26. Differential overhang sequences can be used to ensure inclusion of all guides into a final vector.

TABLE 26

Vector overhang sequences.

| Vector | Overhang 1 | Overhang 2 |
|---|---|---|
| pMGA-1, pMGA-2, pMGA-11 | ACCT | AACA |
| pMGB-1, pMGB-2, pMGB-11 | AACA | GGCT |
| pMGC-1, pMGC-2, pMGC-11 | GGCT | TCAG |
| pMGD-1, pMGD-2, pMGD-11 | TCAG | CTGC |

The U6 promoter can comprise any one of pU6-1, pU6-2 and pU6-11, described below. Guide entry vectors for all 3 promoters were designed and named pMGA-1, pMGB-1, pMGC-1, pMGD-1, pMGA-2, pMGB-2, pMGC-2, pMGD-2, pMGA-11, pMGB-11, pMGC-11 and pMGD-11.

```
pU6-1 promoter:
                              (SEQ ID NO: 400)
CGATTTCTTTAGGGCCGTAGGCTAGTAATCATCGACCGTT

TTAATCATTAATGTACTTAGACAATAAATATAAGATGCAA

TACAAGTCAATGGGAGAAACTAGACTTTACAAAACCTTTA

AAAGCCCTGGTGAGATATGAGAAGGTTTATGACAGAATAT

ATCGCCATTAATGTGAGGTTGTGGACACTGCTGGTAGTCA

AGGCTGCCCGTGAACCATATTTAGTCACATGTAATCACCC

CGCGTGCTAAACAAAAAGCAAAATATCAGTAAGATAGTCA

CAGTCATAACACTGTTGAAT.

>pU6-2 promoter:
                              (SEQ ID NO: 401)
TGCCAAAAAGCCTTCTTGTGGCCTGCTTACTATTAAGGCA

ACTAATTCAAGAACAAGTGATTCTGGGTAGGTAGATGCCA

CAGTTCATGATAATAAAGGCGAAGTCAGAAGGAGTAGTCC

GTTGATGAAGAAAGCAGAAGGCAAGGAATGTTGGTGGCTT

TTGGTTGCGGTAGCACTGAAACCGTGTCCGGACTTCGCCG

GGAGCAGACAATGGCTTGGTTGGATTACATAATAATACCC

CGCGGGCCAGACAATATTCAAAATCCTAACAAAGATGTCT

CAGGTAATACATTCGCTAAT.

pU6-11 promoter:
                              (SEQ ID NO: 403)
GGTACCAGCAGTACCAGCACCAGCCACTGCATTATTGAAT

CTGACATCTGCAACAGCAAGGTACAATTTTTGTTTTACAT
```

```
-continued
TTTACTCATTAATATTAGCACCTATAGCTGTGGCCAATCT

TTTGACGACGACTCTCTCACGCTGGAGGAAAGCATGGTAC

GGGCATTAATTGCCAGCGTAGAACAAGCGTAGGATATGGG

CAACCTCGCTGATTTCTATATTTGGTAAGAAGTCTCACCC

CGTGAGCTAAGCAAAAAGCAAAACCCTTGCTATGTCAACA

TCCCACTGCCATACACTATT.
```

Figure 5:
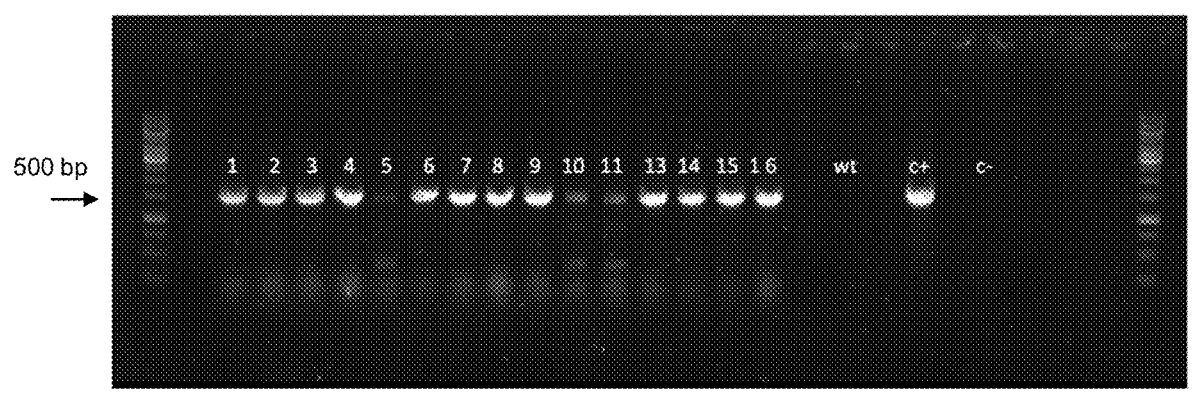
FIG. 5 shows a PCR gel confirming a PsiD genetic modification of a fungal cell. "C+" indicates a lane loaded with a positive control. "C−" indicates a lane loaded with a negative control. "wt" indicates a lane from a PCR run performed on wild-type fungal material. The absence of signal in the "wt" lane and positive signal in lanes 1-16 demonstrates a PsiD transgene is integrated into the genome of the fungal cell.

FIG. 5 shows an alignment of three U6 promoters used for gene editing. U6 is highlighted between residues 282 and 420. A conserved region ca 40 nt upstream of the three U6 promoters is highlighted between residues 222 and 281.

Overhangs for guide insertion are as follow (TABLE 27). Note that the last four nucleotide in the original sequence of the U6-1 promoter overhang is GTTT. Because it can be the same as the scaffold overhang, the sequence can be changed to GAAT to avoid recirculization of the plasmid without a guide, thereby enhancing cloning efficiency.

TABLE 27

Overhangs sequences for guide insertion

| Vector | Overhang A | Overhang B |
|---|---|---|
| pMGA-1, pMGB-1, pMGC-1, pMGD-1 | GAAT | GTTT |
| pMGA-2, pMGB-2, pMGC-2, pMGD-2 | TAAT | GTTT |
| pMGA-11, pMGB-11, pMGC-11, pMGD-11 | TATT | GTTT |

BbsI site can be GAAGAC (forward, 5'→3' orientation) and GTCTTC (reverse, 5'→3' orientation). Ccdb negative selection marker can allow selection for vectors with guide RNA inserted in place of ccdb by transforming a ccdb sensitive E. coli strain (eg DH5α). Sequence of ccdb (in bold), including promoter and terminator sequence, is as follows:

```
                              (SEQ ID NO: 404)
gccggatccagtgctaacatggtctagaaggaggtcagct atgcagtttaaggtttacacctataaaagagagagccgtt atcgtctgtttgtggatgtacagagtgatattattgacac gcccgggcgacggatggtgatccccctggccagtgcacgt ctgctgtcagataaagtctcccgtgaactttacccagtgg tgcatatcggggatgaaagctggcgcatgatgaccaccga tatggccagtgtgccagtctccgttatcggggaagaagtg gctgatctcagccaccgcgaaaatgacatcaaaaacgcca ttaacctgatgttctggggaatataactgcagaggaggta atcaa.
```

Sequence of guide RNA scaffold, including U6 terminator (TTTTTT) is as follows:

```
                              (SEQ ID NO: 405)
GTTTTAGAGCTAGAAATAGCAAGTTAAAATAAGGCTAGTC

CGTTATCAACTTGAAAAAGTGGCACCGAGTCGGTGCTTTT

TT.
```

The guides can be ordered as a pair of oligos with additional nucleotides at the 5' end to generate overhangs allowing their oriented insertion in the entry vector directly downstream of the U6 promoter and directly upstream of the scaffold sequence (see overhangs A and B sequence in TABLE 27). Note that a "G" or a "C" can be added after the four nucleotides overhangs specific of the U6 promoters of the forward oligo or at the end of the reverse oligo, respectively, to increase transcription mediated by RNA Pol III.

Figure 6:
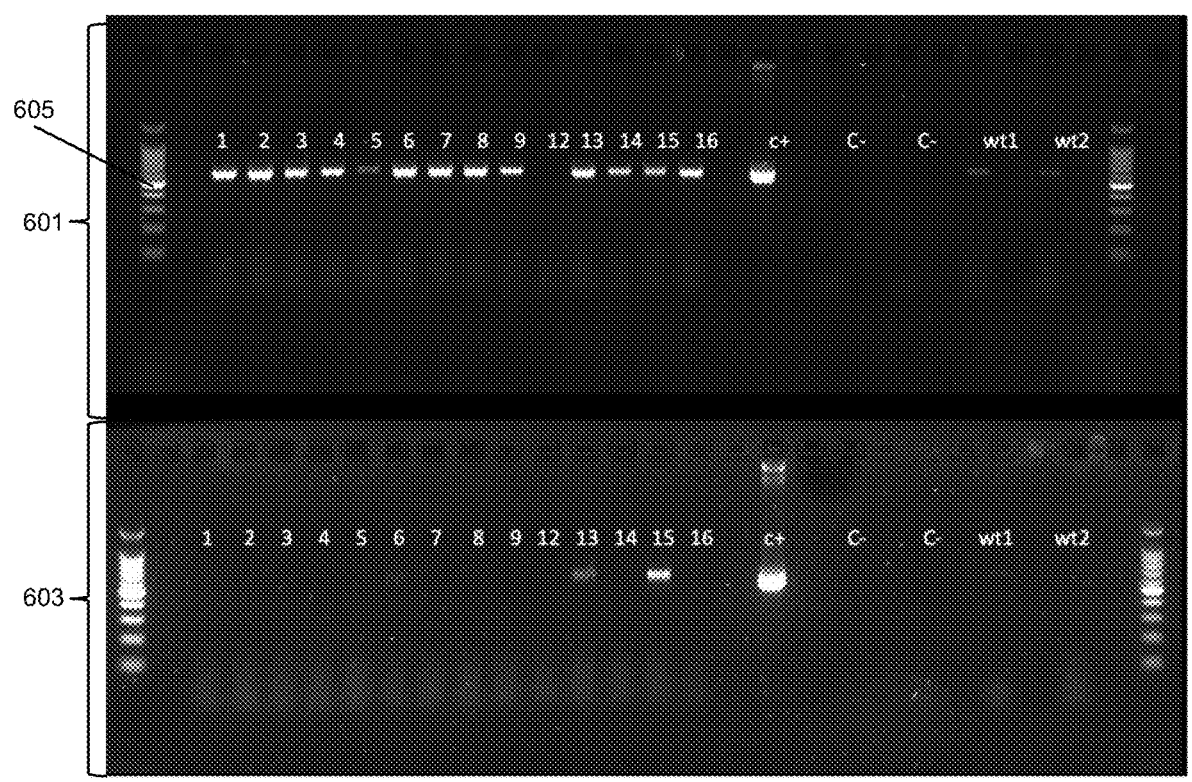
FIG. 6 shows an image capture of electrophoresis gels confirming PsiD upregulation in transgenic mycelia. The gels are from cDNA analyses of PsiD mRNA expression in mycelia transformed with the GT6 plasmid. The top gel is from a cDNA analysis (RT-PCR) of total expressed mRNA in transgenic mycelia. The bottom gel is from a cDNA analysis of expressed PsiD mRNA in transgenic mycelia in which no reverse transcriptase was added during the RT-PCR assay, thus confirming the PsiD signal observed in the top gel is expressed mRNA and not contaminating DNA.

FIG. 6 shows an illustration on guide oligo design. The forward oligo starts with a 4 nucleotide specific of the U6 promoter used (highlighted NNNN) followed by a "G" (highlighted) and the 20 nucleotide sequence of the guide. The reverse oligo starts with the reverse of the 4 nucleotide sequence at the start of the scaffold (highlighted CAAA) followed by the reverse complement sequence of the guide ending with "C" (highlighted).

The pMGE vector can comprise a BsaI site (forward orientation), Overhang 1 for assembly in destination vector, GPD (Glyceraldehyde-3-phosphate dehydrogenase) promoter from *Agaricus bisporus* including the ATG, the first intron and the first six base pairs. Codon optimized 3×FLAG tag followed by a linker Codon optimized nuclear localization signal followed by a linker, a codon optimised Cas9 nuclease or Ca9 nickase (D10A), a Codon optimized linker followed by a nuclear localization signal, a 35S terminator sequence, an Overhang 2 for assembly in destination vector, and BsaI site (reverse orientation). The BsaI site is GGTCTC (forward, 5'→3' orientation) and GAGACC (reverse, 5'→3' orientation). The overhangs for assembly in destination vector pMGE are: Overhang 1=CTGC, Overhang 2=ACTA. Exemplary pMGE plasmid sequences are disclosed in TABLE 28 below.

The GPD promoter can be selected from *Agaricus bisporus* and includes an ATG, the first intron and the first six base pairs is as follow (the ATG is indicated in bold).

(SEQ ID NO: 406)
GAGCTCTGAAAGACGCAGCCGACGGTAAACACCCGGGCAT

CGAGAAAGGCATTGTCGACTATACGGAAGAAGACGTTGT

TTCCACCGATTTCGTTGGGAGCAACTATTCGATGATCTTT

GACGCAAAAGCGGGCATCGCGTTGAACTCGCGTTTTATGA

AATTAGTTGCATGGTATGATAATGAGTGGGGATATGCGCG

TAGAGTCTGCGATGAGGTTGTGTATGTAGCGAAGAAGAAT

TAAGAGGTCCGCAAGTAGATTGAAAGTTCAGTACGTTTTT

AACAATAGAGCATTTTCGAGGCTTGCGTCATTCTGTGTCA

GGCTAGCAGTTTATAAGCGTTGAGGATCTAGAGCTGCTGT

TCCCGCGTCTCGAATGTTCTCGGTGTTTAGGGGTTAGCAA

TCTGATATGATAATAATTTGTGATGACATCGATAGTACAA

AAACCCCAATTCCGGTCACATCCACCATCTCCGTTTCTC

CCATCTACACACAACAAGCTCATCGCCggtaccATGGTTT

GTCTCTCGCTTGCATACCACCCAGCAGCTCACTGATGTCG

ACTTGTAGGTTAAA.

TABLE 28. Shows the codon usage of *Psilocybe cubensis*, which was determined using CDS sequences retrieved on NCBI.

| Amino Acid | Codon | Number | /1000 | Fraction | Amino Acid | Codon | Number | /1000 | Fraction |
|---|---|---|---|---|---|---|---|---|---|
| Ala | GCG | 94973 | 14.52 | 0.22 | Pro | CCG | 79990 | 12.23 | 0.19 |
| Ala | GCA | 121349 | 18.56 | 0.28 | Pro | CCA | 121988 | 18.65 | 0.3 |
| Ala | GCT | 113730 | 17.39 | 0.26 | Pro | CCT | 113983 | 17.43 | 0.28 |
| Ala | GCC | 104417 | 15.97 | 0.24 | Pro | CCC | 96889 | 14.82 | 0.23 |
| Cys | TGT | 75561 | 11.55 | 0.44 | Gln | CAG | 114865 | 17.56 | 0.43 |
| Cys | TGC | 94986 | 14.53 | 0.56 | Gln | CAA | 151660 | 23.19 | 0.57 |
| Asp | GAT | 132793 | 20.31 | 0.52 | Arg | AGG | 90788 | 13.88 | 0.16 |
| Asp | GAC | 124558 | 19.05 | 0.48 | Arg | AGA | 110000 | 16.82 | 0.2 |
| Glu | GAG | 127447 | 19.49 | 0.44 | Arg | CGG | 70127 | 10.72 | 0.13 |
| Glu | GAA | 160283 | 24.51 | 0.56 | Arg | CGA | 108563 | 16.6 | 0.19 |
| Phe | TTT | 109108 | 16.68 | 0.46 | Arg | CGT | 78277 | 11.97 | 0.14 |
| Phe | TTC | 129072 | 19.74 | 0.54 | Arg | CGC | 99031 | 15.14 | 0.18 |
| Gly | GGG | 78228 | 11.96 | 0.2 | Ser | AGT | 69177 | 10.58 | 0.11 |
| Gly | GGA | 131519 | 20.11 | 0.33 | Ser | AGC | 95888 | 14.66 | 0.15 |
| Gly | GGT | 86256 | 13.19 | 0.22 | Ser | TCG | 104024 | 15.91 | 0.17 |
| Gly | GGC | 99150 | 15.16 | 0.25 | Ser | TCA | 119741 | 18.31 | 0.19 |
| His | CAT | 108009 | 16.52 | 0.53 | Ser | TCT | 121560 | 18.59 | 0.2 |
| His | CAC | 96412 | 14.74 | 0.47 | Ser | TCC | 112783 | 17.25 | 0.18 |
| Ile | ATA | 73121 | 11.18 | 0.24 | Thr | ACG | 89684 | 13.71 | 0.22 |
| Ile | ATT | 112802 | 17.25 | 0.36 | Thr | ACA | 113328 | 17.33 | 0.28 |
| Ile | ATC | 124576 | 19.05 | 0.4 | Thr | ACT | 91341 | 13.97 | 0.23 |
| Lys | AAG | 134938 | 20.63 | 0.49 | Thr | ACC | 104734 | 16.02 | 0.26 |
| Lys | AAA | 143241 | 21.9 | 0.51 | Val | GTG | 79614 | 12.17 | 0.24 |
| Leu | TTG | 112353 | 17.18 | 0.2 | Val | GTA | 56238 | 8.6 | 0.17 |
| Leu | TTA | 57064 | 8.73 | 0.1 | Val | GTT | 95569 | 14.61 | 0.29 |
| Leu | CTG | 101270 | 15.49 | 0.18 | Val | GTC | 103728 | 15.86 | 0.31 |
| Leu | CTA | 63224 | 9.67 | 0.11 | Trp | TGG | 118221 | 18.08 | 1 |
| Leu | CTT | 115383 | 17.64 | 0.2 | Tyr | TAT | 91196 | 13.95 | 0.52 |
| Leu | CTC | 126659 | 19.37 | 0.22 | Tyr | TAC | 84918 | 12.99 | 0.48 |
| Met | ATG | 119768 | 18.31 | 1 | End | TGA | 83153 | 12.72 | 0.54 |
| Asn | AAT | 111562 | 17.06 | 0.49 | End | TAG | 31329 | 4.79 | 0.2 |
| Asn | AAC | 114327 | 17.48 | 0.51 | End | TAA | 38905 | 5.95 | 0.25 |

The Sequence of the codon optimized 3×FLAG tag followed by a linker is as follows:

(SEQ ID NO: 200)
gattataaagatcatgatggagattataaagatcatgatatcgattata
aagatgatgatgataaagcagca.

Sequence of the codon optimized nuclear localization signal followed by a linker is as follows:

(SEQ ID NO: 201)
ccaaaaaaaaaagaaaagtcggaatccatggagtcccagcagca.

The sequence of the codon optimized Cas9 nuclease is as follows (note that the sequence of Cas9 nickase is identical except for the GAT codon highlighted in mutated to GCA):

(SEQ ID NO: 203)
gataaaaaatattcaatcggattggatatcggaacaaactcagtggatgggcagtcatcacagatgaatataaagtcccatcaaaaaaattc aaagtcttgggaaacacagatagacattcaatcaaaaaaaacttgatcggagcattgttgttcgattcaggagaaacagcagaagcaacaag attgaaagaacagcaagaagaagatatacaagaagaaaaaacagaatctgctatttgcaagaaatcttctcaaacgaaatggcaaagtc gatgattcattcttccatagattggaagaatcattcttggtcgaagaagataaaaaacatgaaagacatccaatcttcggaaacatcgtcgatg aagtcgcatatcatgaaaaatatccaacaatctatcatttgagaaaaaattggtcgattcaacagataaagcagatttgagattgatctatttgg cattggcacatatgatcaaattcagaggacatttcttgatcgaaggagatttgaacccagataactcagatgtcgataaattgttcatccaattg gtccaaacatataaccaattgttcgaagaaacccaatcaacgcatcaggagtcgatgcaaaagcaatcttgtcagcaagattgtcaaaatca agaagattggaaaacttgatcgcacaattgccaggagaaaaaaaaacggattgttcggaaacttgatcgcattgtcattgggattgacacc aaacttcaaatcaaacttcgatttggcagaagatgcaaaattgcaattgtcaaaagatacatatgatgatgatttggataacttgttggcacaaat cggagatcaatatgcagatttgttcttggcagcaaaaaacttgtcagatgcaatcttgttgtcagatatcttgagagtcaacacagaaatcacaa aagcaccattgtcagcatcaatgatcaaaagatatgatgaacatcatcaagatttgacattgttgaaagcattggtcagacaacaattgccaga aaaatataaagaaatcttcttcgatcaatcaaaaaacggatatgcaggatatatcgatgggaggagcatcacaagaagaattctataaattcatc aaaccaatcttggaaaaaatggatggaacagaagaattgttggtcaaattgaacagagaagatttgttgagaaaacaaagaacattcgataa cggatcaatcccacatcaaatccatttgggagaattgcatgcaatcttgagaagacaagaagatttctatccattcttgaaagataacagagaa aaaatcgaaaaaatcttgacattcagaatcccatattatgtcggaccattggcaagaggaaactcaagattcgcatggatgacaagaaaatca gaagaaacaatcacaccatggaacttcgaagaagtcgtcgataaaggagcatcagcacaatcattcatcgaaagaatgacaaacttcgata aaaacttgccaaacgaaaaagtcttgccaaaacattcattgttgtatgaatatttcacagtctataacgaattgacaaaagtcaaatatgtcaca gaaggaatgagaaaaccagcattcttgtcaggagaacaaaaaaagcaatcgtcgatttgttgttcaaaacaaacagaaagtcacagtca aacaattgaaagaagattatttcaaaaaaatcgaatgcttcgattcagtcgaaatctcaggagtcgaagatagattcaacgcatcattgggaac atatcatgatttgttgaaaatcatcaaagataaagatttcttggataacgaagaaaacgaagatatcttggaagatatcgtcttgacattgacatt gttcgaagatagagaaatgatcgaagaaagattgaaaacatatgcacatttgttcgatgataaagtcatgaaacaattgaaaagaagaagata tacaggatggggaagattgtcaagaaaattgatcaacggaatcagagataaacaatcaggaaaaacaatcttggatttcttgaaatcagatg gattcgcaaacagaaacttcatgcaattgatccatgatgattcattgacattcaaagaagatatccaaaaagcacaagtctcaggacaaggag attcattgcatgaacatatcgcaaacttggcaggatcaccagcaatcaaaaaaggaatcttgcaaacagtcaaagtcgtcgatgaattggtca aagtcatgggaagacataaaccagaaacatcgtcatcgaaatggcaagagaaaaccaaacaacacaaaaggacaaaaaaactcaag agaaagaatgaaaagaatcgaagaaggaatcaagaattgggatcacaaatcttgaaagaacatccagtcgaaaacacacaattgcaaaa cgaaaaattgtatttgtattatttgcaaaacggaagagatatgtatgtcgatcaagaattggatatcaacagattgtcagattatgatgtcgatc atatcgtcccacaatcattcttgaaagatgattcaatcgataacaaagtcttgacaagatcagataaaaacagaggaaatcagataacgtccca tcagaagaagtcgtcaaaaaaatgaaaaactattggagacaattgttgaacgcaaaattgatcacacaaagaaaattcgataacttgacaaaa gcagaaagaggaggattgtcagaattggataaagcaggattcatcaaaagacaattggtcgaaacaagacaaatcacaaaacatgtcgca caaatcttggattcaagaatgaacacaaaatatgatgaaaacgataaattgatcagagaagtcaaagtcatcacattgaaatcaaaattggttt cagatttcagaaaagatttccaattctataaagtcagagaaatcaacaactatcatcatgcacatgatgcatatttgaacgcagtcgtcggaac agcattgatcaaaaaatatccaaaattggaatcagaattcgtctatggagattataaagtctatgatgtcagaaaaatgatcgcaaaatcagaa caagaaatcggaaaagcaacagcaaaatatttcttctcattcaaacatcatgaacttcttcaaaacagaaatcacattggcaaacggagaaatc

```
agaaaaagaccattgatcgaaacaaacggagaaacaggagaaatcgtctgggataaaggaagagatttcgcaacagtcagaaaagtcttg tcaatgccacaagtcaacatcgtcaaaaaaacagaagtccaaacaggaggattctcaaaagaatcaatcttgccaaaaagaaactcagata aattgatcgcaagaaaaaagattgggatccaaaaaaatatggaggattcgattcaccaacagtcgcatattcagtcttggtcgtcgcaaaag tcgaaaaaggaaaatcaaaaaaattgaaatcagtcaaagaattgttgggaatcacaatcatggaaagatcatcattcgaaaaaaacccaatc gatttcttggaagcaaaaggatataaagaagtcaaaaaagatttgatcatcaaattgccaaaatattcattgttcgaattggaaaacggaagaa aaagaatgttggcatcagcaggagaattgcaaaaaggaaacgaattggcattgccatcaaaatatgtcaacttcttgtatttggcatcacattat gaaaaattgaaaggatcaccagaagataacgaacaaaaacaattgttcgtcgaacaacataaacattatttggatgaaatcatcgaacaaatc tcagaattctcaaaaagagtcatcttggcagatgcaaacttggataaagtcttgtcagcatataacaaacatagagataaaccaatcagagaa caagcagaaaacatcatccatttgttcacattgacaaacttgggagcaccagcagcattcaaatatttcgatacaacaatcgatagaaaaga tatacatcaacaaaagaagtcttggatgcaacattgatccatcaatcaatcacaggattgtatgaaacaagaatcgatttgtcacaattgggag gagat.
```

The sequence of the codon optimized linker followed by a nuclear localization signal:

(SEQ ID NO: 202)
ggaatccatggagtcccagcagcaccaaaaaaaaaaagaaaagtctga.

The 35S terminator sequence is as follow:

(SEQ ID NO: 204)
AGTAGATGCCGACCGGATCTGTCGATCGACAAGCTCGAGTTTCTCCATA
ATAATGTGTGAGTAGTTCCCAGATAAGGGAATTAGGGTTCCTATAGGGT
TTCGCTCATGTGTTGAGCATATAAGAAACCCTTAGTATGTATTTGTATT
TGTAAAATACTTCTATCAATAAAATTTCTAATTCCTAAAACCAAAATCC
AGTACTAAAATCCAGATC.

The following elements can be part of the pMGF vectors: a BsaI site (forward orientation), Overhang 1 for assembly in destination vector, a 35S promoter. Hygromycin resistance gene, a 35S terminator sequence, an Overhang 2 for assembly in destination vector, a BsaI site (reverse orientation). The BsaI site is GGTCTC (forward, 5'→3' orientation) and GAGACC (reverse, 5'→3' orientation) Overhangs for assembly in destination vector (TABLE 29).

TABLE 29

Overhangs for destination vector.

| Vector | Overhang 1 | Overhang 2 |
|---|---|---|
| pMGF | ACTA | GTAT |

35S promoter sequence can comprise a sequence as follows:

(SEQ ID NO: 205)
TGAGACTTTTCAACAAAGGGTAATATCGGGAAACCTCCTCGGATTCCAT
TGCCCAGCTATCTGTCACTTCATCAAAAGGACAGTAGAAAAGGAAGGTG
GCACCTACAAATGCCATCATTGCGATAAAGGAAAGGCTATCGTTCAAGA
TGCCTCTGCCGACAGTGGTCCCAAAGATGGACCCCCACCCACGAGGAGC
ATCGTGGAAAAGAAGACGTTCCAACCACGTCTTCAAAGCAAGTGGATT
GATGTGATAACATGGTGGAGCACGACACTCTCGTCTACTCCAAGAATAT
CAAAGATACAGTCTCAGAAGACCAAAGGGCTATTGAGACTTTTCAACAA
AGGGTAATATCGGGAAACCTCCTCGGATTCCATTGCCCAGCTATCTGTC
ACTTCATCAAAAGGACAGTAGAAAAGGAAGGTGGCACCTACAAATGCCA
TCATTGCGATAAAGGAAAGGCTATCGTTCAAGATGCCTCTGCCGACAGT
GGTCCCAAAGATGGACCCCCACCCACGAGGAGCATCGTGGAAAAGAAG
ACGTTCCAACCACGTCTTCAAAGCAAGTGGATTGATGTGATATCTCCAC
TGACGTAAGGGATGACGCACAATCCCACTATCCTTCGCAAGACCTTCCT
CTATATAAGGAAGTTCATTTCATTTGGAGAGGACACGCTGAAATCACCA
GTCTCTCTCTACAAATCTATCTCTCTCGAGCTTTCGCAGATCCCGGGGG
GCAATGAGAT.

Hygromycin resistance can comprise sequence:

(SEQ ID NO: 206)
ATGAAAAAGCCTGAACTCACCGCGACGTCTGTCGAGAAGTTTCTGATCG
AAAAGTTCGACAGCGTCTCCGACCTGATGCAGCTCTCGGAGGGCGAAGA
ATCTCGTGCTTTCAGCTTCGATGTAGGAGGGCGTGGATATGTCCTGCGG
GTAAATAGCTGCGCCGATGGTTTCTACAAAGATCGTTATGTTTATCGGC
ACTTTGCATCGGCCGCGCTCCCGATTCCGGAAGTGCTTGACATTGGGGA
GTTTAGCGAGAGCCTGACCTATTGCATCTCCCGCCGTGCACAGGGTGTC
ACGTTGCAAGACCTGCCTGAAACCGAACTGCCCGCTGTTCTACAACCGG
TCGCGGAGGCTATGGATGCGATCGCTGCGGCCGATCTTAGCCAGACGAG
CGGGTTCGGCCCATTCGGACCGCAAGGAATCGGTCAATACACTACATGG
CGTGATTTCATATGCGCGATTGCTGATCCCCATGTGTATCACTGGCAAA
CTGTGATGGACGACACCGTCAGTGCGTCCGTCGCGCAGGCTCTCGATGA
GCTGATGCTTTGGGCCGAGGACTGCCCCGAAGTCCGGCACCTCGTGCAC
GCGGATTTCGGCTCCAACAATGTCCTGACGGACAATGGCCGCATAACAG
CGGTCATTGACTGGAGCGAGGCGATGTTCGGGGATTCCCAATACGAGGT
CGCCAACATCTTCTTCTGGAGGCCGTGGTTGGCTTGTATGGAGCAGCAG

-continued

ACGCGCTACTTCGAGCGGAGGCATCCGGAGCTTGCAGGATCGCCACGAC

TCCGGGCGTATATGCTCCGCATTGGTCTTGACCAACTCTATCAGAGCTT

GGTTGACGGCAATTTCGATGATGCAGCTTGGGCGCAGGGTCGATGCGAC

GCAATCGTCCGATCCGGAGCCGGGACTGTCGGGCGTACACAAATCGCCC

GCAGAAGCGCGGCCGTCTGGACCGATGGCTGTGTAGAAGTACTCGCCGA

TAGTGGAAACCGACGCCCCAGCACTCGTCCGAGGGCAAAGAAATAG.

35S terminator sequence can be as follow:

(SEQ ID NO: 207)
AGTAGATGCCGACCGGATCTGTCGATCGACAAGCTCGAGTTTCTCCATA

ATAATGTGTGAGTAGTTCCCAGATAAGGGAATTAGGGTTCCTATAGGGT

TTCGCTCATGTGTTGAGCATATAAGAAACCCTTAGTATGTATTTGTATT

TGTAAAATACTTCTATCAATAAAATTTCTAATTCCTAAAACCAAAATCC

AGTACTAAAATCCAGATC.

Vectors, pMGA, B, C and D can be combined and ligated with pMGE and pMGF into a destination vector. The destination vector can include left and right border sequences that can be recognized by an endonuclease, such as, a VirD1 and/or VirD2 enzyme, inside an *agrobacterium*. Inside the *agrobacterium*, vectors pMGA, B, C and D, pMGE and pMGF, can be excised. The border sequence may comprise 25 bp border sequences that act as a nicking site for endonuclease. For example, VirD1, a site-specific helicase, unwinds double-stranded DNA. A nuclease, VirD2, cuts the bottom strand of DNA from the right and left border, becoming single-stranded linear DNA, which is exported out of the bacterium and into the fungal cell by enzymes.

Inside the fungal cell, the gene editing system can introduce one or more genetic modifications. The gene editing system can comprise an endonuclease and at least one guide polynucleotide, or one or more nucleic acids encoding said endonuclease and the at least one guide polynucleotide, wherein the endonuclease forms a complex with the guide polynucleotide to binds to a nucleic acid present in the fungal cell and alter production on an alkaloid. The gene editing system can further include and a reagent that facilitates incorporation of the gene editing system into the fungal cell. In some embodiments, the fungal cell is a fungal protoplast. In some embodiments, the fungal cell is from the genus *Psilocybe*.

ADDITIONAL EXEMPLARY EMBODIMENTS

1. A composition comprising an engineered fungal cell that comprises a genetic modification which comprises an exogenous polynucleotide, wherein expression of the exogenous polynucleotide results in a polypeptide having indolethylamine N-methyltransferase (INMT) activity; and wherein the engineered fungal cell comprises N,N-dimethyltryptamine (DMT).
2. The composition of embodiment 1, wherein the engineered fungal cell comprises a polypeptide having INMT activity.
3. The composition of embodiment 2, wherein the engineered fungal cell has increased expression of a PsiD gene as compared to the expression of a PsiD gene in a comparable wild type fungal cell.
4. The composition of embodiment 1, wherein the engineered fungal cell comprises an increased amount of DMT in comparison to the amount of DMT in a comparable wild type fungal cell.
5. The composition of embodiment 2, wherein the engineered fungal cell has an increased amount of DMT in comparison to the amount of DMT in a comparable wild type fungal cell.
6. The composition of embodiment 4, wherein the increased amount of DMT is demonstrated by: i) a distinct phenotype, ii) spectrophotometric analysis; iii) amount of DMT per amount of dry weight of a fungus comprising the engineered fungal cell, or iv) a combination of any of these.
7. The composition of embodiment 4, wherein the engineered fungal cell has an increased amount of DMT and an increased amount of psilocybin, psilocin, or both, in comparison to the amount of DMT and the amount of psilocybin, psilocin, or both, in a comparable wild type fungal cell.
8. The composition of embodiment 1, wherein the engineered fungal cell is from the division Basidiomycota.
9. The composition of embodiment 8, wherein the engineered fungal cell is from a *psilocybe* fungus.
10. The composition of embodiment 1, wherein the exogenous polynucleotide comprises a human INMT (Hs-INMT) gene.
11. The composition of embodiment 1, wherein the exogenous polynucleotide comprises a zebrafish INMT (ZfINMT) gene.
12. The composition of embodiment 1, wherein the engineered fungal cell has decreased expression of a PsiH gene, a PsiH2 gene, or both, as compared to the expression of a PsiH gene, a PsiH2 gene, or both in a comparable wild type fungal cell.
13. The composition of embodiment 3, wherein the engineered fungal cell is from the division Basidiomycota.
14. The composition of embodiment 13, wherein the engineered fungal cell is from a *psilocybe* fungus.
15. The composition of embodiment 3, wherein the exogenous polynucleotide comprises human INMT (Hs-INMT) gene.
16. The composition of embodiment 3, wherein the exogenous polynucleotide comprises a zebrafish INMT (ZfINMT) gene.
17. The composition of embodiment 3, wherein the engineered fungal cell has decreased expression of a PsiH gene, a PsiH2 gene, or both, as compared to the expression of a PsiH gene, a PsiH2 gene, or both, in a comparable wild type fungal cell.
18. The composition of embodiment 1, wherein the engineered fungal cell further comprises increased expression of a polynucleotide encoding a polypeptide having aromatic amino acid decarboxylase (AAAD) activity.
19. The composition of embodiment 18, wherein the engineered fungal cell comprises an increased amount of DMT in comparison to the amount of DMT in a comparable wild type fungal cell.
20. The composition of embodiment 19, wherein the increased amount of DMT is demonstrated by i) a distinct phenotype, ii) spectrophotometric analysis; iii) amount of DMT per amount of dry weight of a fungus comprising the engineered fungal cell, or iv) a combination of any of these.
21. The composition of embodiment 19, wherein the engineered fungal cell has an increased amount of DMT and an increased amount of psilocybin, psilocin, or both, in comparison to the amount of DMT and the amount of psilocybin, psilocin, or both, in a comparable wild type fungal cell.

22. The composition of embodiment 18, wherein the engineered fungal cell is from the division Basidiomycota.

23. The composition of embodiment 22, wherein the engineered fungal cell is from a *psilocybe* fungus.

24. The composition of embodiment 17, wherein the exogenous polynucleotide comprises a human INMT (HsINMT) gene.

25. The composition of embodiment 17, wherein the exogenous polynucleotide comprises a zebrafish INMT (ZfINMT) gene.

26. The composition of embodiment 18, wherein the engineered fungal cell has decreased expression of a PsiH gene, a PsiH2 gene, or both.

27. The composition of embodiment 2, wherein the engineered fungal cell has increased expression of a AAAD gene.

28. The composition of embodiment 1 or embodiment 18, wherein increased expression is measured by a method comprising reverse transcriptase-polymerase chain reaction (RT-PCR).

29. The composition of embodiment 1, wherein the exogenous polynucleotide comprises an INMT gene that is a *Psilocybe cubensis* optimized INMT gene.

30. The composition of embodiment 18, wherein the exogenous polynucleotide comprises a polynucleotide sequence that is at least 95% identical to SEQ ID NO: 92.

31. The composition of any one of embodiments 1-30, wherein the engineered fungal cell further comprises an increased amount of N,N-dimethyltryptophan (DMTP) compared to a comparable wild-type fungal cell.

32. The composition of any one of embodiments 1-31, wherein the engineered fungal cell comprises a decreased amount of a second alkaloid compared to the amount of the second alkaloid in a comparable wild-type fungal cell.

33. The composition of any one of embodiments 1-31, wherein the engineered fungal cell comprises a comparable amount of a second alkaloid compared to the amount of the second alkaloid in a comparable wild-type fungal cell.

34. The composition of any one of embodiments 32-33, wherein the second alkaloid is psilocybin.

35. A composition comprising an engineered fungal cell that comprises a first genetic modification, wherein the first genetic modification results in increased expression of INMT or AAAD, or a combination of both, and wherein the engineered fungal cell comprises a modulated expression of PsiD compared to a comparable wild type fungal cell.

36. The composition of embodiment 35, wherein the engineered fungal cell has an increased number of PsiD gene copies compared to a comparable wildtype fungal cell.

37. The composition of embodiment 35, wherein the first genetic modification comprises a modification of a promoter operatively linked to the PsiD gene.

38. The composition of embodiment 35, wherein the first genetic modification comprises a genetic modification that induces a frame shift in the PsiD gene such that when the PsiD gene is transcribed and translated, a protein expressed from the PsiD gene that comprises the genetic modification, has decreased function.

39. The composition of embodiment 38, where the first genetic modification comprises excision of the PsiD gene.

40. The composition of embodiment 39, wherein the excision is a CRISPR mediated excision.

41. The composition of embodiment 35, wherein the engineered fungal cell further comprises a second genetic modification that comprises a first exogenous polynucleotide that comprises a hygromycin resistance gene.

42. The composition of embodiment 41, wherein the first exogenous polynucleotide is stably incorporated into the engineered fungal cell's genome.

43. The composition of embodiment 41, wherein the first exogenous polynucleotide is not stably incorporated in the engineered fungal cell's genome.

44. The composition of embodiment 42, wherein the first exogenous polynucleotide is comprised in a plasmid present in the engineered fungal cell.

45. The composition of embodiment 43, wherein the first exogenous polynucleotide is operably linked to a promoter.

46. The composition of embodiment 45, wherein the promoter is a 35S promoter.

47. The composition of embodiment 45, wherein the first exogenous polynucleotide is operably linked to the promoter.

48. The composition of embodiment 47, wherein the promoter is a 35S promoter.

49. The composition of embodiment 35, wherein the second genetic modification comprises a second exogenous polynucleotide, wherein the second exogenous polynucleotide comprises an INMT gene.

50. The composition of embodiment 35, wherein the engineered fungal cell comprises an increased amount of an alkaloid compared to a comparable wild-type fungal cell.

51. The composition of embodiment 50, wherein the alkaloid is N,N-dimethyltryptamine (DMT).

52. The composition of embodiment 50, wherein the increased amount of the alkaloid is determined by a spectrophotometric method.

53. The composition of embodiment 35, wherein the engineered fungal cell comprises an increased amount of an alkaloid compared to a comparable wild-type fungal cell.

54. The composition of embodiment 53, wherein the alkaloid is N,N-dimethyltryptamine (DMT).

55. The composition of embodiment 53, wherein the increased amount of the alkaloid is determined by a spectrophotometric method.

56. The composition of embodiment 49, wherein the second exogenous polynucleotide is an INMT gene.

57. The composition of embodiment 56, wherein the INMT gene is a human INMT (HsINMT) gene.

58. The composition of embodiment 57, wherein the engineered fungal cell comprises an increased amount of an alkaloid compared to a comparable wild-type fungal cell.

59. The composition of embodiment 58, wherein the alkaloid is N,N-dimethyltryptamine (DMT).

60. The composition of embodiment 57, wherein the increased amount of the alkaloid is determined by a spectrophotometric method.

61. The composition of any preceding embodiment, wherein the engineered fungus is of Basidiomycota.

62. The composition of any preceding embodiment, wherein the composition, the engineered fungal cell, or both further comprise a monoamine oxidase inhibitor.
63. The composition of any one of embodiments 35-62, wherein the engineered fungal cell is comprised in a fungus or a portion thereof.
64. A composition comprising an engineered fungal cell that comprises a first genetic modification and a second genetic modification, wherein the first genetic modification results in decreased expression of a PsiD gene product; and the second genetic modification results in an increased expression of a protein encoded by a hygromycin resistance gene.
65. The composition of embodiment 64, wherein the first genetic modification comprises a modification of a promoter operatively linked to the PsiD gene.
66. The composition of embodiment 64, wherein the first genetic modification comprises a genetic modification that induces a frame shift in the PsiD gene such that when the PsiD gene is transcribed and translated, a protein expressed from the PsiD gene that comprises the genetic modification, has diminished function, or is not functional, compared to a protein expressed from a comparable PsiD gene that does not comprise the genetic modification.
67. The composition of embodiment 64, where the first genetic modification comprises excision of the PsiD gene.
68. The composition of embodiment 67, wherein the excision is a CRISPR mediated excision.
69. The composition of embodiment 64, wherein the second genetic modification comprises a first exogenous polynucleotide that comprises a hygromycin resistance gene.
70. The composition of embodiment 69, wherein the first exogenous polynucleotide is stably incorporated into the engineered fungal cell's genome.
71. The composition of embodiment 69, wherein the first exogenous polynucleotide is not stably incorporated in the engineered fungal cell's genome.
72. The composition of embodiment 70, wherein the first exogenous polynucleotide is comprised in a plasmid present in the engineered fungal cell.
73. The composition of embodiment 70, wherein the first exogenous polynucleotide is operably linked to a promoter.
74. The composition of embodiment 73, wherein the promoter is a 35S promoter.
75. The composition of embodiment 71, wherein the first exogenous polynucleotide is operably linked to a promoter.
76. The composition of embodiment 75, wherein the promoter is a 35S promoter.
77. The composition of embodiment 70, wherein the engineered fungal cell further comprises a second exogenous polynucleotide that comprises an INMT gene.
78. The composition of embodiment 77, wherein the engineered fungal cell comprises an increased amount of an alkaloid compared to a comparable wild-type fungal cell.
79. The composition of embodiment 78, wherein the alkaloid is N,N-dimethyltryptamine (DMT).
80. The composition of embodiment 78, wherein the increased amount of the alkaloid is determined by a spectrophotometric method.
81. The composition of embodiment 71, wherein the engineered fungal cell further comprises a second exogenous polynucleotide that comprises an INMT gene.
82. The composition of embodiment 81, wherein the engineered fungal cell comprises an increased amount of an alkaloid compared to a comparable wild-type fungal cell.
83. The composition of embodiment 82, wherein the alkaloid is N,N-dimethyltryptamine (DMT).
84. The composition of embodiment 82, wherein the increased amount of the alkaloid is determined by a spectrophotometric method.
85. The composition of embodiment 72, wherein the engineered fungal cell further comprises a second exogenous polynucleotide that comprises an INMT gene.
86. The composition of embodiment 85, wherein the engineered fungal cell comprises an increased amount of an alkaloid compared to a comparable wild-type fungal cell.
87. The composition of embodiment 86, wherein the alkaloid is N,N-dimethyltryptamine (DMT).
88. The composition of embodiment 86, wherein the increased amount of the alkaloid is determined by a spectrophotometric method.
89. The composition of embodiment 85, wherein the INMT gene is a human INMT (HsINMT) gene.
90. The composition of embodiment 89, wherein the engineered fungal cell comprises an increased amount of an alkaloid compared to a comparable wild-type fungal cell.
91. The composition of embodiment 90, wherein the alkaloid is N,N-dimethyltryptamine (DMT).
92. The composition of embodiment 90, wherein the increased amount of the alkaloid is determined by a spectrophotometric method.
93. The composition of any preceding embodiment, wherein the engineered fungus is of Basidiomycota.
94. The composition of any preceding embodiment, wherein the composition, the engineered fungal cell, or both further comprise a monoamine oxidase inhibitor.
95. The composition of any one of embodiments 64-94, wherein the engineered fungal cell is comprised in a fungus or a portion thereof.
96. A composition, wherein the composition comprises: an engineered fungal cell, wherein the engineered fungal cell comprises a modification, wherein the modification provides for reduction of expression of psilocybin phosphatase in the engineered fungal cell as compared to a comparable fungal cell without the modification.
97. The composition of embodiment 96, wherein the engineered fungal cell is from the genus *Psilocybe*.
98. The composition of embodiment 96, wherein the modification comprises a deletion or an insertion of a nucleotide in a nucleic acid sequence encoding psilocybin phosphatase.
99. The composition of embodiment 98, wherein the nucleic acid sequence comprises at least a portion of one of SEQ ID NOS: 15-16.
100. The composition of embodiment 96, wherein the modification comprises a deletion or an insertion of a nucleotide in a promoter or an enhancer of a gene that encodes psilocybin phosphatase.
101. The composition of embodiment 96, wherein the modification comprises an exogenous nucleic acid that is incorporated into the engineered fungal cell, and wherein the exogenous nucleic acid encodes a gene product that, when expressed, suppresses or eliminates the expression of psilocybin phosphatase in the engineered fungal cell.

102. The composition of embodiment 101, wherein the gene product comprises an siRNA or an shRNA, wherein the siRNA or shRNA comprises a nucleic acid sequence that is complementary to mRNA encoding psilocybin phosphatase.

103. The composition of embodiment 102, wherein the siRNA or shRNA comprises a sequence that is complementary to at least a portion of any one of SEQ ID NOS: 15-16.

104. The composition of embodiment 96, wherein the modification reduces expression of psilocybin phosphatase by at least 50% as compared to a comparable fungal cell without said modification.

105. The composition of embodiment 96, wherein the modification results in a decreased expression of psilocin in the engineered fungal cell as compared to a comparable fungal cell without the modification.

106. The composition of embodiment 96, wherein the modification results in an increased expression of psilocybin in the engineered fungal cell as compared to a comparable fungal cell without the modification.

107. The composition of embodiment 96, wherein the engineered fungal cell further comprises a second modification that results in at least one of: increased tryptophan decarboxylation, increased tryptamine 4-hydroxylation, increased 4-hydroxytryptamine O-phosphorylation, or increased psilocybin production via sequential N-methylations as compared to a comparable fungal cell without the second modification.

108. The composition of embodiment 96, wherein the engineered fungal cell further comprises a second modification that results in an increased expression of a gene product as compared to a comparable fungal cell without the second modification, wherein the gene product is encoded by a gene selected from the group consisting of PsiD, PsiM, PsiH, PsiH2, PsiK, and PsiR.

109. The composition of embodiment 108, wherein the second modification comprises an exogenous nucleic acid that is incorporated into the engineered fungal cell, wherein the exogenous nucleic acid comprises a sequence that is at least 95% identical to any one of SEQ ID NOS: 1-19, or 90.

110. The composition of embodiment 108, wherein the gene product is expressed in the engineered fungal cell by at least 6-fold greater than as expressed in a comparable fungal cell without the second modification.

111. The composition of embodiment 109, wherein the exogenous nucleic acid comprises a gene promoter that is positioned upstream of one of PsiD, PsiM, PsiH, PsiK, or PsiR, wherein the gene promoter is any one of a 35S promoter, a GDP promoter, or a CcDED1 promoter.

112. The composition of any one of embodiments 96-111, wherein the modification is accomplished by contacting a fungal cell with a gene editing system.

113. The composition of embodiment 112, wherein the gene editing system comprises a guide polynucleotide.

114. The composition of embodiment 18, wherein the guide polynucleotide binds to a gene comprising any one of SEQ ID NOS: 29-87.

115. The composition of embodiment 96, wherein the fungal cell is a fungal protoplast.

116. The composition of embodiment 112, wherein the gene editing system comprises one of a Cas endonuclease, an *agrobacterium*-mediated insertion of exogenous nucleic acid, TALE-nuclease, a transposon-based nuclease, a zinc finger nuclease, a meganuclease, a mega-TAL or DNA guided nuclease.

117. The composition of embodiment 96, wherein composition is in the form of an aerosol, powder, gel, semi-gel, liquid or solid.

118. The composition of embodiment 96, wherein the modification provides for elimination of expression.

119. A pharmaceutical composition comprising the engineered fungal cell or an extract thereof from any one of embodiments 96-118.

120. The pharmaceutical composition of embodiment 119, wherein the pharmaceutical composition comprises a pharmaceutically acceptable carrier.

121. The pharmaceutical composition of embodiment 119 or 120, wherein the pharmaceutical composition is formulated as a dosage form for topical, oral, inhalation, or intestinal delivery.

122. The pharmaceutical composition of any one of embodiments 119-121, wherein the pharmaceutical composition comprises an effective amount of the engineered fungal cell or the extract thereof for treating a health condition.

123. The pharmaceutical composition of any one of embodiments 119-122, wherein the composition is formulated such that an effective amount of the composition for treatment of the health condition can be delivered in a single dose format.

124. A nutraceutical composition comprising an extract of the engineered fungal cell of any one of embodiments 96-111.

125. A supplement comprising an extract of the engineered fungal cell of any one of embodiments 96-118.

126. A food supplement comprising an extract of the engineered fungal cell of any one of embodiments 96-118.

127. A method of treatment, wherein the method comprises administering the composition or an extract thereof from any one of embodiments 96-118 to a subject diagnosed with a health condition.

128. The method of embodiment 127, wherein the health condition comprises one of depression, anxiety, post-traumatic stress, addiction, or psychological distress including cancer-related psychological distress.

129. A composition comprising:
an engineered fungal cell comprising:
  a genetic modification that results in at least a 6-fold increase in expression of mRNA encoding L-tryptophan decarboxylase in the engineered fungal cell as compared to a comparable fungal cell that is devoid of said genetic modification,
  wherein the fungal cell is from division Basidiomycota.

130. The composition of embodiment 129, wherein the fungal cell comprises a mycelium.

131. The composition of embodiment 129, wherein the genetic modification comprises an exogenous nucleic acid that is integrated into the engineered fungal cell, wherein the exogenous nucleic acid comprises one or more genes and at least one of the one or more genes encodes L-tryptophan decarboxylase.

132. The composition of embodiment 131, wherein the at least one of the one or more genes comprises a sequence that is at least 95% identical to SEQ ID NO: 90.

133. The composition of embodiment 131, wherein the exogenous nucleic acid comprises a promoter that is located upstream of the one or more genes, wherein the promoter comprises one of a 35S promoter, a GPD promoter, or a CcDED1 promoter.

134. The composition of embodiment 32, wherein the exogenous nucleic acid comprises a gene selected from TABLE 2.

135. The composition of embodiment 131, wherein the exogenous nucleic acid comprises a sequence that is at least 95% identical to SEQ ID NO: 90.

136. The composition of embodiment 131, wherein the exogenous nucleic acid sequence is integrated into a chromosome of the engineered fungal cell with a gene editing system.

137. The composition of embodiment 136, wherein the gene editing system comprises a guide polynucleotide that can bind to a sequence comprising any one of SEQ ID NOS: 29-87.

138. The composition of embodiment 136, wherein the exogenous nucleic acid is integrated into the chromosome at a region involved in regulation of psilocybin synthesis.

139. The composition of embodiment 129, wherein the engineered fungal cell comprises a phenotype that is visually distinct from a comparable fungal cell that is devoid of said genetic modification, wherein the phenotype comprises a color of blue.

140. The composition of embodiment 129, wherein the engineered fungal cell reflects light having a wavelength of between about 450 and 500 nanometers.

141. The composition of embodiment 129, wherein the genetic modification results in an increased expression of psilocybin in the fungal cell as compared to a comparable fungal cell without said genetic modification.

142. The composition of embodiment 129, wherein the engineered fungal cell further comprises a second modification that results in one of increased tryptamine 4-hydroxylation, increased 4-hydroxytryptamine O-phosphorylation, increased psilocybin production via sequential N-methylations, or decreased psilocybin dephosphorylation as compared to a comparable fungal cell without the second modification.

143. The composition of embodiment 129, wherein the engineered fungal cell further comprises a second modification that results in an increased expression of a gene product as compared to a comparable fungal cell without the second modification, wherein the gene product is involved in psilocybin synthesis and is encoded by any one of PsiM, PsiH, PsiH2, PsiK, or PsiR.

144. The composition of embodiment 143, wherein the gene product is upregulated by at least 6-fold as compared to a comparable fungal cell without the second modification.

145. The composition of embodiment 129, wherein the genetic modification is accomplished by contacting a fungal cell with a gene editing system.

146. The composition of embodiment 145, wherein the gene editing system comprises a guide polynucleotide.

147. The composition of embodiment 145, wherein the guide polynucleotide binds to a gene comprising any one of SEQ ID NOS: 29-87.

148. The composition of embodiment 145, wherein the gene editing system comprises any one of a Cas endonuclease, an *agrobacterium*-mediated insertion of exogenous nucleic acid, a TALE-Nuclease, a transposon-based nuclease, a zinc finger nuclease, a meganuclease, a mega-TAL or DNA guided nuclease.

149. The composition of embodiment 129, wherein composition is in the form of an aerosol, powder, gel, semi-gel, liquid or solid.

150. A pharmaceutical composition comprising the engineered fungal cell or an extract thereof from any one of embodiments 129-144.

151. The pharmaceutical composition of embodiment 150, wherein the pharmaceutical composition is formulated such that an effective amount of the composition for treating a health condition can be delivered in a single dose format to a subject in need thereof.

152. The pharmaceutical composition of embodiment 151, wherein the pharmaceutical composition comprises a pharmaceutically acceptable carrier.

153. The pharmaceutical composition of embodiment 150 or 151, wherein the pharmaceutical composition is formulated as a dosage form for topical, oral, inhalation, or intestinal delivery.

154. The pharmaceutical composition of any one of embodiments 151-153, wherein the health condition comprises one of depression, anxiety, post-traumatic stress, addiction, or psychological distress including cancer-related psychological distress.

155. A nutraceutical composition comprising an extract of the engineered fungal cell of any one of embodiments 129-144.

156. A supplement comprising an extract of the engineered fungal cell of any one of embodiment 129-144.

157. A food supplement comprising an extract of the engineered fungal cell of any one of embodiment 129-144.

158. A composition comprising:
an engineered fungal cell comprising:
   a first genetic modification that results in increased expression of L-tryptophan decarboxylase in the engineered fungal cell as compared to a comparable fungal cell without the first genetic modification; and
   a second genetic modification that results in decreased expression of psilocybin phosphatase in the engineered fungal cell as compared to a comparable fungal cell without the second genetic modification.

159. The composition of embodiment 158, wherein the fungal cell is from *Psilocybe cubensis* or *Stropharia cubensis*.

160. The composition of embodiment 158, wherein the first genetic modification comprises an exogenous nucleic acid that is incorporated in the engineered fungal cell, wherein the exogenous nucleic acid encodes L-tryptophan decarboxylase.

161. The composition of embodiment 160, wherein the exogenous nucleic acid comprises a sequence that is at least 95% identical to SEQ ID NO: 90.

162. The composition of embodiment 160, wherein the exogenous nucleic acid further comprises a sequence that is a gene promoter, wherein the gene promoter comprises any one of a 35S promoter, a GPD promoter, or a CcDED1 promoter.

163. The composition of embodiment 160, wherein the exogenous nucleic acid comprises one or more copies of a gene selected from TABLE 2.

164. The composition of embodiment 158, wherein the second genetic modification comprises a deletion of at least a portion of an endogenous nucleic acid sequence that encodes psilocybin phosphatase.

165. The composition of embodiment 164, wherein the endogenous nucleic acid sequence comprises a sequence that is at least 95% identical to SEQ ID NO: 90.
166. The composition of embodiment 158, wherein the second genetic modification comprises an indel within a promoter or an enhancer of a gene that encodes psilocybin phosphatase.
167. The composition of embodiment 158, wherein the second genetic modification comprises an insertion of an exogenous nucleic acid sequence into the engineered fungal cell, wherein the exogenous nucleic acid sequence encodes a gene product that, when expressed, suppresses or eliminates the expression of mRNA encoding psilocybin phosphatase.
168. The composition of embodiment 158, wherein the first genetic modification results in at least a 6-fold increase in expression of L-tryptophan decarboxylase in the engineered fungal cell as compared to a comparable fungal cell that is devoid of said first genetic modification.
169. The composition of embodiment 158, wherein the second genetic modification suppresses expression of psilocybin phosphatase by at least 50% as compared to a comparable fungal cell without said second genetic modification.
170. The composition of embodiment 158, wherein the second genetic modification results in a decreased expression of psilocin in the engineered fungal cell as compared to a comparable fungal cell without the second genetic modification.
171. The composition of embodiment 158, wherein the fungal cell further comprises an exogenous nucleic acid sequence that encodes a gene, wherein the gene is one PsiM, PsiH, PsiH2, PsiK, or PsiR.
172. The composition of embodiment 171, wherein the gene is upregulated in the engineered fungal cell by at least 6-fold as compared to a comparable fungal cell without the exogenous nucleic acid sequence.
173. The composition of embodiment 158, wherein composition is in the form of an aerosol, powder, gel, semi-gel, liquid or solid.
174. The composition of embodiment 158, wherein the first or second genetic modification is accomplished by contacting a fungal cell with a gene editing system.
175. The composition of embodiment 174, wherein the gene editing system comprises one of a Cas endonuclease, a TALE-nuclease, an *agrobacterium*-mediated insertion of exogenous nucleic acid, a transposon-based nuclease, a zinc finger nuclease, a meganuclease, a mega-TAL or DNA guided nuclease.
176. A pharmaceutical composition comprising the engineered fungal cell thereof of any one of embodiments 158-175.
177. The pharmaceutical composition of embodiment 176, wherein the composition is formulated such that an effective amount of the composition for treating a health condition can be delivered in a single dose format to a subject in need thereof.
178. The pharmaceutical composition of embodiment 177, wherein the health condition comprises any one of depression, anxiety, post-traumatic stress, addiction, or psychological distress including cancer-related psychological distress.
179. A nutraceutical composition comprising an extract of the engineered fungal cell of any one of embodiments 158-172.
180. A supplement comprising an extract of the engineered fungal cell of any one of embodiment 158-172.
181. A food supplement comprising an extract of the engineered fungal cell of any one of embodiment 158-172.
182. An engineered fungus comprising:
a genetic modification that results in an increased expression of L-tryptophan decarboxylase such that the engineered fungus or a portion thereof changes from a first color to a second color upon exposure to air, wherein the second color is visually distinct from a color of a corresponding portion of a comparable fungus without the genetic modification upon an equivalent exposure of air.
183. The engineered fungus of embodiment 182, wherein the second color reflects light having a wavelength between about 450 and 500 nanometers.
184. The engineered fungus of embodiment 182, wherein the genetic modification comprises an exogenous nucleic acid encoding one or more genes.
185. The engineered fungus of embodiment 184, wherein the one or more genes comprises encodes L-tryptophan decarboxylase.
186. The engineered fungus of embodiment 184, wherein the one or more genes are positioned on the exogenous nucleic acid downstream of a gene promoter, wherein the gene promoter is one of a 35S promoter, a GPD promoter, or CcDED1 promoter.
187. The engineered fungus of embodiment 184, wherein the exogenous nucleic acid comprises SEQ ID NO: 90.
188. The engineered fungus of embodiment 184, wherein the exogenous nucleic acid is incorporated into the engineered fungus with a vector.
189. The engineered fungus of embodiment 188, wherein the vector is selected from the group consisting of pGWB5, pGHGWY, and pGHGWY.
190. The engineered fungus of embodiment 182, wherein the engineered fungus comprises a concentration of psilocybin that is at least 10% greater than a concentration of psilocybin in a comparable fungus devoid of said genetic modification.
191. The engineered fungus of embodiment 182, wherein the fungus is selected from the group consisting of *Psilocybe, Conocybe, Gyranopilus, Panaeolus, Pluteus,* and *Stropharia*.
192. The engineered fungus of embodiment 184, wherein the one or more transgenes are selected from the group consisting of (i) PsiD, (ii) PsiD and PsiK, (iii) PsiD, PsiK, PsiM, and (iv) PsiD, PsiK, PsiM, PsiH.
193. The engineered fungus of embodiment 182, wherein the genetic modification results in a 6-fold increase in L-tryptophan decarboxylase expression as compared to a comparable fungus devoid of said genetic modification.
194. The engineered fungus of embodiment 182, wherein the fungus further comprises a second modification that results in at least one of increased tryptophan decarboxylation, increased tryptamine 4-hydroxylation, increased 4-hydroxytryptamine O-phosphorylation, increased psilocybin production via sequential N-methylations, or decreased psilocybin dephosphorylation as compared to a comparable fungus without the second modification.
195. The engineered fungus of embodiment 182, wherein the engineered fungus comprises a second modification that results in an increased expression of a gene as compared to a comparable fungus without the second modification, wherein the gene is selected from PsiD, PsiM, PsiH, PsiK, or PsiR.

196. The engineered fungus of embodiment 195, wherein the second modification comprises an exogenous nucleic acid that is incorporated into the engineered fungus, wherein the exogenous nucleic acid comprises a sequence that is at least 95% identical to one of SEQ ID NOS: 1-19, or 90.

197. The engineered fungus of embodiment 195, wherein the gene is upregulated by at least 6-fold as compared to a comparable fungus without the second modification.

198. A pharmaceutical composition comprising the engineered fungus or an extract of the engineered fungus of any one of embodiments 182-197.

199. The pharmaceutical composition of embodiment 198, wherein the composition comprises an effective amount of the engineered fungus or an extract of the engineered fungus for treating a health condition.

200. The pharmaceutical composition of embodiment 200, wherein the composition is formulated such that an effective amount of the composition for treatment of the health condition can be delivered in a single dose format.

201. A nutraceutical composition comprising an extract of the engineered fungus of any one of embodiment 182-197.

202. A food supplement comprising an extract of the engineered fungus of any one of embodiment 182-197.

203. The engineered fungus of any one of embodiments 182-197, wherein the modification is accomplished by contacting a fungal cell with a gene editing system and growing the fungal cell into a fungus.

204. The composition of embodiment 203, wherein the gene editing system comprises any one of a Cas endonuclease, a TALE-nuclease, a transposon-based nuclease, an *agrobacterium*-mediated insertion of exogenous nucleic acid a zinc finger nuclease, a meganuclease, a mega-TAL or DNA guided nuclease.

205. A method of treatment, wherein the method comprises administering the engineered fungus or an extract of the engineered fungus of any one of embodiments 182-197 to a subject diagnosed with a health condition.

206. The method of embodiment 205, wherein the health condition comprises one of depression, anxiety, post-traumatic stress, addiction, or psychological distress including cancer-related psychological distress.

207. A method comprising:
introducing an exogenous nucleic acid encoding L-tryptophan decarboxylase into a fungal cell;
growing the fungal cell into a mycelial mass; and
expressing L-tryptophan decarboxylase in the mycelial mass, wherein the presence of the exogenous nucleic acid results in an increased level of L-tryptophan decarboxylase expression in the mycelial mass expressing as compared to a comparable wild-type mycelial mass.

208. The method of embodiment 207, wherein the fungal cell is a fungal protoplast.

209. The method of embodiment 207, wherein the fungal cell is from division Basidiomycota.

210. The method of embodiment 207, wherein the exogenous nucleic acid comprises a sequence that is at least 95% identical to SEQ ID NO: 90.

211. The method of embodiment 207, wherein the expression of L-tryptophan decarboxylase results in the mycelial mass comprising a phenotype that is visually distinct from a phenotype of a comparable mycelial mass that is devoid of said genetic modification, wherein the phenotype comprises a color of blue.

212. The method of embodiment 207, wherein the mycelial mass reflects a wavelength of light that is between 450 and 500 nanometers.

213. The method of embodiment 207, wherein the expression of L-tryptophan decarboxylase from the exogenous nucleic acid results in increased production of psilocybin in the mycelial mass as compared to a comparable mycelial mass without the exogenous nucleic acid.

214. The method of embodiment 207, wherein the mycelial mass comprises a concentration of psilocybin that is greater than 1.7% as measured by dry mycelial mass.

215. The method of embodiment 207, wherein the exogenous nucleic acid is introduced into the mycelial mass by an *agrobacterium*.

216. The method of embodiment 207, wherein the exogenous nucleic acid is introduced into the mycelial mass with a vector, wherein the vector comprises one of pGWB5, pGHGWY, or pGHGWY.

217. The method of embodiment 207, wherein expressing L-tryptophan decarboxylase is accomplished with a gene promoter located on the exogenous nucleic acid, wherein the gene promoter comprises one of a 35S promoter, a GPD promoter, or a CcDED1 promoter.

218. The method of embodiment 207, wherein the mycelial mass comprises a second genetic modification that suppresses or eliminates expression of psilocybin phosphatase in the mycelial mass as compared to a comparable mycelial mass without said modification.

219. The method of embodiment 218, wherein the second genetic modification is achieved by deleting at least a portion of an endogenous nucleic acid sequence involved in expressing psilocybin phosphatase.

220. The method of embodiment 218, wherein the second genetic modification suppresses expression of psilocybin phosphatase by at least 50% as compared to a comparable mycelial mass without said second genetic modification.

221. The method of embodiment 218, wherein the second genetic modification results in a decreased expression of psilocin in the mycelial mass as compared to a comparable mycelial mass without the second genetic modification.

222. The method of embodiment 207, further comprising expressing an exogenous nucleic acid sequence in the mycelial mass, wherein the exogenous nucleic acid sequence encodes a gene, wherein the gene is selected from PsiD, PsiM, PsiH, PsiK, or PsiR.

223. The method of embodiment 222, wherein the gene is upregulated in the mycelial mass by at least 10-fold as compared to a comparable fungus without the exogenous nucleic acid sequence.

224. A method comprising:
obtaining a genetically modified organism comprising a genetic modification, wherein the genetic modification results in increased expression of L-tryptophan decarboxylase as compared to a comparable organism without said genetic modification;
detecting, from a tissue of the genetically modified organism, a change from a first color to a second color upon exposure of the tissue to air, wherein the second color is visually distinct from tissue of a comparable organism upon an equivalent exposure of air.

225. The method of embodiment 224, wherein the change to the second color occurs within 5 minutes.
226. The method of embodiment 224, wherein the second color comprises a reflected wavelength of light that is between 450 and 500 nanometers.
227. The method of embodiment 224, wherein obtaining the genetically modified organism comprises introducing an exogenous nucleic acid encoding L-tryptophan decarboxylase into a cell of a fungus, thereby generating the genetically modified organism.
228. The method of embodiment 224, wherein the exogenous nucleic acid comprises a sequence that is at least 95% identical to SEQ ID NO: 90.
229. The method of embodiment 224, wherein the second color is generated as a result of an oxidation of the tissue.
230. The method of embodiment 224, further comprising assessing a concentration of psilocybin in the genetically modified organism based on the second color, wherein the appearance of the second color is indicative of a psilocybin concentration that is greater than 1.7% dry mass.
231. The method of embodiment 224, wherein the genetic modification results in at least a 6-fold increase in expression of psilocybin as compared to a comparable organism without said genetic modification.
232. The method of embodiment 224, wherein the genetically modified organism comprises a fungus from division Basidiomycota.
233. The method of embodiment 224, further comprising expressing an exogenous nucleic acid sequence in the genetically modified organism, wherein the exogenous nucleic acid sequence encodes a gene, wherein the gene is selected from PsiD, PsiM, PsiH, PsiK, or PsiR.
234. The method of embodiment 233, wherein the gene is upregulated in the genetically modified organism by at least 6-fold as compared to a comparable fungus without the exogenous nucleic acid sequence.
235. A pharmaceutical composition comprising the composition of any preceding embodiment, and a pharmaceutically acceptable: diluent, carrier, excipient, or any combination thereof.
236. The pharmaceutical composition of embodiment 235, that is in unit dose form.
237. A kit comprising the pharmaceutical composition of any preceding embodiment, and a container.
238. A method of treating a health condition, disease, or disorder in a subject, the method comprising administering the composition or pharmaceutical composition of any preceding embodiment, to the subject in an amount effective to treat the health condition, disease, or disorder in the subject.
239. The method of embodiment 238, wherein the subject is a subject in need thereof.
240. The method of embodiment 238 or embodiment 239, wherein the health condition, disease or disorder is a neurological health condition, disease, or disorder.
241. The method of embodiment 240, wherein the neurological health condition, disease, or disorder is: a depression, an anxiety, a post-traumatic stress disorder (PTSD), a psychiatric disorder, mental trauma, a mood disorder, a speech disorder, neurodegenerative disease, psychological distress, a compulsion, a compulsive disorder, an obsessive disorder, an expression of a symptom in a neurodivergent individual, cancer-related psychological distress, an addiction, a headache, multiple sclerosis, amyotrophic lateral sclerosis (ALS), Alzheimer's disease, Parkinson's disease a phobia, a dementia, a fear, an eating disorder, an ischemic event, or any combination thereof.
242. The composition or pharmaceutical composition of any preceding embodiment, further comprising a monoamine oxidase (MAO) inhibitor, an inhibitor of MAO A, or an inhibitor of MAO B.
243. The method of any preceding embodiment, further comprising administering concurrently or consecutively with the composition or pharmaceutical composition, a monoamine oxidase (MAO) inhibitor, an inhibitor of MAO A, or an inhibitor of MAO B.

FURTHER EMBODIMENTS

1. A composition comprising an engineered fungal cell that comprises a genetic modification which comprises an exogenous polynucleotide, wherein expression of the exogenous polynucleotide results in a polypeptide having indolethylamine N-methyltransferase (INMT) activity; and wherein the engineered fungal cell comprises N,N-dimethyltryptamine (DMT).
2. The composition of embodiment 1, wherein the engineered fungal cell comprises a polypeptide having INMT activity.
3. The composition of embodiment 2, wherein the engineered fungal cell has increased expression of a PsiD gene as compared to the expression of a PsiD gene in a comparable wild type fungal cell.
4. The composition of embodiment 1, wherein the engineered fungal cell comprises an increased amount of DMT in comparison to the amount of DMT in a comparable wild type fungal cell.
5. The composition of embodiment 2, wherein the engineered fungal cell has an increased amount of DMT in comparison to the amount of DMT in a comparable wild type fungal cell.
6. The composition of embodiment 4, wherein the increased amount of DMT is demonstrated by: i) a distinct phenotype, ii) spectrophotometric analysis; iii) amount of DMT per amount of dry weight of a fungus comprising the engineered fungal cell, or iv) a combination of any of these.
7. The composition of embodiment 4, wherein the engineered fungal cell has an increased amount of DMT and an increased amount of psilocybin, psilocin, or both, in comparison to the amount of DMT and the amount of psilocybin, psilocin, or both, in a comparable wild type fungal cell.
8. The composition of embodiment 1, wherein the engineered fungal cell is from the division Basidiomycota.
9. The composition of embodiment 8, wherein the engineered fungal cell is from a *psilocybe* fungus.
10. The composition of embodiment 1, wherein the exogenous polynucleotide comprises a human INMT (Hs-INMT) gene.
11. The composition of embodiment 1, wherein the exogenous polynucleotide comprises a zebrafish INMT (ZfINMT) gene.
12. The composition of embodiment 1, wherein the engineered fungal cell has decreased expression of a PsiH gene, a PsiH2 gene, or both, as compared to the expression of a PsiH gene, a PsiH2 gene, or both in a comparable wild type fungal cell.
13. The composition of embodiment 3, wherein the engineered fungal cell is from the division Basidiomycota.

14. The composition of embodiment 13, wherein the engineered fungal cell is from a *psilocybe* fungus.
15. The composition of embodiment 3, wherein the exogenous polynucleotide comprises human INMT (HsINMT) gene.
16. The composition of embodiment 3, wherein the exogenous polynucleotide comprises a zebrafish INMT (ZfINMT) gene.
17. The composition of embodiment 3, wherein the engineered fungal cell has decreased expression of a PsiH gene, a PsiH2 gene, or both, as compared to the expression of a PsiH gene, a PsiH2 gene, or both, in a comparable wild type fungal cell.
18. The composition of embodiment 1, wherein the engineered fungal cell further comprises increased expression of a polynucleotide encoding a polypeptide having aromatic amino acid decarboxylase (AAAD) activity.
19. The composition of embodiment 18, wherein the engineered fungal cell comprises an increased amount of DMT in comparison to the amount of DMT in a comparable wild type fungal cell.
20. The composition of embodiment 19, wherein the increased amount of DMT is demonstrated by i) a distinct phenotype, ii) spectrophotometric analysis; iii) amount of DMT per amount of dry weight of a fungus comprising the engineered fungal cell, or iv) a combination of any of these.
21. The composition of embodiment 19, wherein the engineered fungal cell has an increased amount of DMT and an increased amount of psilocybin, psilocin, or both, in comparison to the amount of DMT and the amount of psilocybin, psilocin, or both, in a comparable wild type fungal cell.
22. The composition of embodiment 18, wherein the engineered fungal cell is from the division Basidiomycota.
23. The composition of embodiment 22, wherein the engineered fungal cell is from a *psilocybe* fungus.
24. The composition of embodiment 17, wherein the exogenous polynucleotide comprises a human INMT (HsINMT) gene.
25. The composition of embodiment 17, wherein the exogenous polynucleotide comprises a zebrafish INMT (ZfINMT) gene.
26. The composition of embodiment 18, wherein the engineered fungal cell has decreased expression of a PsiH gene, a PsiH2 gene, or both.
27. The composition of embodiment 2, wherein the engineered fungal cell has increased expression of a AAAD gene.
28. The composition of embodiment 1 or embodiment 18, wherein increased expression is measured by a method comprising reverse transcriptase-polymerase chain reaction (RT-PCR).
29. The composition of embodiment 1, wherein the exogenous polynucleotide comprises an INMT gene that is a *Psilocybe cubensis* optimized INMT gene.
30. The composition of embodiment 18, wherein the exogenous polynucleotide comprises a polynucleotide sequence that is at least 95% identical to SEQ ID NO: 92.
31. The composition of any one of embodiments 1-30, wherein the engineered fungal cell further comprises an increased amount of N,N-dimethyltryptophan (DMTP) compared to a comparable wild-type fungal cell.
32. The composition of any one of embodiments 1-31, wherein the engineered fungal cell comprises a decreased amount of a second alkaloid compared to the amount of the second alkaloid in a comparable wild-type fungal cell.
33. The composition of any one of embodiments 1-31, wherein the engineered fungal cell comprises a comparable amount of a second alkaloid compared to the amount of the second alkaloid in a comparable wild-type fungal cell.
34. The composition of any one of embodiments 32-33, wherein the second alkaloid is psilocybin.
35. A composition comprising an engineered fungal cell that comprises a first genetic modification, wherein the first genetic modification results in increased expression of INMT or AAAD, or a combination of both, and wherein the engineered fungal cell comprises a modulated expression of PsiD compared to a comparable wild type fungal cell.
36. The composition of embodiment 35, wherein the engineered fungal cell has an increased number of PsiD gene copies compared to a comparable wildtype fungal cell.
37. The composition of embodiment 35, wherein the first genetic modification comprises a modification of a promoter operatively linked to the PsiD gene.
38. The composition of embodiment 35, wherein the first genetic modification comprises a genetic modification that induces a frame shift in the PsiD gene such that when the PsiD gene is transcribed and translated, a protein expressed from the PsiD gene that comprises the genetic modification, has decreased function.
39. The composition of embodiment 38, where the first genetic modification comprises excision of the PsiD gene.
40. The composition of embodiment 39, wherein the excision is a CRISPR mediated excision.
41. The composition of embodiment 35, wherein the engineered fungal cell further comprises a second genetic modification that comprises a first exogenous polynucleotide that comprises a hygromycin resistance gene.
42. The composition of embodiment 41, wherein the first exogenous polynucleotide is stably incorporated into the engineered fungal cell's genome.
43. The composition of embodiment 41, wherein the first exogenous polynucleotide is not stably incorporated in the engineered fungal cell's genome.
44. The composition of embodiment 42, wherein the first exogenous polynucleotide is comprised in a plasmid present in the engineered fungal cell.
45. The composition of embodiment 43, wherein the first exogenous polynucleotide is operably linked to a promoter.
46. The composition of embodiment 45, wherein the promoter is a 35S promoter.
47. The composition of embodiment 45, wherein the first exogenous polynucleotide is operably linked to the promoter.
48. The composition of embodiment 47, wherein the promoter is a 35S promoter.
49. The composition of embodiment 35, wherein the second genetic modification comprises a second exogenous polynucleotide, wherein the second exogenous polynucleotide comprises an INMT gene.
50. The composition of embodiment 35, wherein the engineered fungal cell comprises an increased amount of an alkaloid compared to a comparable wild-type fungal cell.

51. The composition of embodiment 50, wherein the alkaloid is N,N-dimethyltryptamine (DMT).
52. The composition of embodiment 50, wherein the increased amount of the alkaloid is determined by a spectrophotometric method.
53. The composition of embodiment 35, wherein the engineered fungal cell comprises an increased amount of an alkaloid compared to a comparable wild-type fungal cell.
54. The composition of embodiment 53, wherein the alkaloid is N,N-dimethyltryptamine (DMT).
55. The composition of embodiment 53, wherein the increased amount of the alkaloid is determined by a spectrophotometric method.
56. The composition of embodiment 49, wherein the second exogenous polynucleotide is an INMT gene.
57. The composition of embodiment 56, wherein the INMT gene is a human INMT (HsINMT) gene.
58. The composition of embodiment 57, wherein the engineered fungal cell comprises an increased amount of an alkaloid compared to a comparable wild-type fungal cell.
59. The composition of embodiment 58, wherein the alkaloid is N,N-dimethyltryptamine (DMT).
60. The composition of embodiment 57, wherein the increased amount of the alkaloid is determined by a spectrophotometric method.
61. The composition of any preceding embodiment, wherein the engineered fungus is of Basidiomycota.
62. The composition of any preceding embodiment, wherein the composition, the engineered fungal cell, or both further comprise a monoamine oxidase inhibitor.

EXAMPLES

Example 1. Generating a Transgenic Fungus that Expresses an Increased Amount of Tryptophan Decarboxylase Preparation of fungal material for genetic modification: Fungal material was prepared for transformation with one of two plasmids encoding PsiD. The plasmids included pCambia1300:GPDstart_intron_6 bp:Gus no intron:stop:polyA (GT 4), and pCambia1300:GPD:intron-PsiD-stop:polyA (GT 6).

FIG. 4 shows a plasmid encoding PsiD. In particular, illustrated is the GT6 plasmid.

Non-transgenic fungal cells from *Psilocybe cubensis* mycelia were maintained on potato dextrose agar (PDA) at 25 degrees Celsius in the dark. The mycelia (cells 3 weeks old or less) were cut into small blocks from agar plates and added to 100 mL potato dextrose broth (PDB) media. The mycelium cultures were incubated in a shaker incubator (at 175 rpm) for six (6) days in the dark at 28° C.

Following incubation, six (6) day old *Psilocybe cubensis* were transferred to fresh PDB medium and homogenized using an Ultra-Turrax homogenizer 24 hours before inoculation. Hyphal fragments were transferred to fresh PDB and grown for 24 hours to give a uniform mycelial slurry under same conditions as the originally maintained mycelia sample.

Bacteria preparation: *A. tumefaciens* strains LBA4404/AGL1 carrying a plasmid of GT4 or GT6 were grown for 24-48 hours in Lysogeny broth (LB) medium supplemented with appropriate antibiotics prior to inoculation. On the day of inoculation, bacterial cultures were diluted to an optical density of 0.15 at 660 nm with *agrobacterium* induction medium (AIM) (Induction medium (AIM) [MM containing 0.5% (w/v) glycerol, 0.2 mM acetosyringone (AS), 40 mM 2-N-morpholino-ethane sulfonic acid (MES), pH 5.3) and grown for an additional 5-6 hours in a shaker incubator at 28 degrees Celsius.

*Agrobacterium*-mediated transformation: A 25 mL aliquot of the mycelial suspension (uniform mycelial slurry) was mixed with 25 mL of one of the bacterial cultures comprising GT4 as prepared as disclosed above. A second 25 mL aliquot of the mycelial suspension (uniform mycelial slurry) was mixed with 25 mL of one of the bacterial cultures comprising GT6 as prepared as disclosed above. 1 mL of each of the mixtures was spread on cellophane discs following vacuum treatment and overlaid on agar plates and incubated at 25° C. for 72-92 hours in the dark. *Agrobacterium* contamination level was observed after 72 hours. Co-cultivation was stopped if *agrobacterium* was visible, otherwise, incubation was continued up to 92 hours.

After cocultivation, cellophane discs were transferred to Selection 1, which included PDA medium containing 200 mg/L Timentin to kill residual *agrobacterium* cells and 80 mg/L Hygromycin to select fungal transformants. Selection 1 was incubated for 10-15 days at 25 degrees Celsius. After Selection 1, individual colonies were transferred to PDA medium containing 80 mg/L Hygromycin and 200 mg/L Timentin (Selection 2).

Example 2. Confirmation of Transgenic Mycelia with an Integrated Exogenous Nucleic Acid and Elevated Levels of Tryptophan Decarboxylase Transformed colonies generated according to Example 1 demonstrated significant growth and were transferred to new selection media every 15 days to selectively grow cells with the exogenous nucleic acid integrated. To confirm integration of the exogenous nucleic acid encoding tryptophan decarboxylase, a GUS assay, short for "beta-glucuronidase", and PCR analysis were performed. Both assays confirmed transformation of the exogenous nucleic acid.

FIG. 5 shows a PCR gel confirming the fungal cell was genetically modified. In particular, the PCR gel confirms incorporation of the GT6 plasmid into fungal mycelia. "C+" indicates a lane loaded with a positive control. "C−" indicates a lane loaded with a negative control. "wt" indicates a lane from a PCR run performed on wild-type fungal material. The absence of signal in the "wt" lane and positive signal at ~about 500 bp in lanes 1-16 is indicative that the PsiD transgene is integrated into the genome of the fungal mycelia.

After confirming integration of the exogenous nucleic acid, additional PCR assays were performed to assess whether tryptophan decarboxylase expression (encoded by PsiD) was elevated. Specifically, quantitative real-time PCR (RT-PCR) assays were performed to assess levels of mRNA encoded by PsiD.

FIG. 6 shows RT-PCR gels that confirm PsiD upregulation in transgenic mycelia. The gels are from cDNA analyses of PsiD mRNA expression in mycelia transformed with the GT6 plasmid. Specifically, the top gel 601 is a gel from a cDNA analysis (RT-PCR) of total expressed mRNA in transgenic mycelia. The data show clear upregulated expression of the transgenic mycelia (bands in lanes 1-16 at about 500 bp (605)) as compared to comparable wild-type mycelia devoid of the genetic modification, i.e., the PsiD transgene. As shown, the expression of PsiD in the transgenic mycelia is approximately 6-10 fold higher than the basal level of expression seen in the wild type cells. The lower gel 603 is a cDNA analysis of expressed PsiD mRNA in transgenic mycelia in which no reverse transcriptase (thus no mRNA is converted into cDNA) was added during the RT-PCR assay confirming the PsiD observed in the top gel 601 is expressed mRNA and not contaminating DNA.

Example 3. Validation of a Transgenic Fungus Expressing Elevated Levels of Tryptophan Decarboxylase Transgenic and non-transgenic colonies were cultured on selection plates with Hygromycin (80 mL) and Timentin (200 mg/L). Surprisingly transgenic mycelia exhibited a phenotype that was visually distinct from the phenotype of non-transgenic colonies. In particular, the mycelial mass from the transgenic fungus showed a blue coloration that was not apparent in non-genetically modified fungi.

Figure 7:
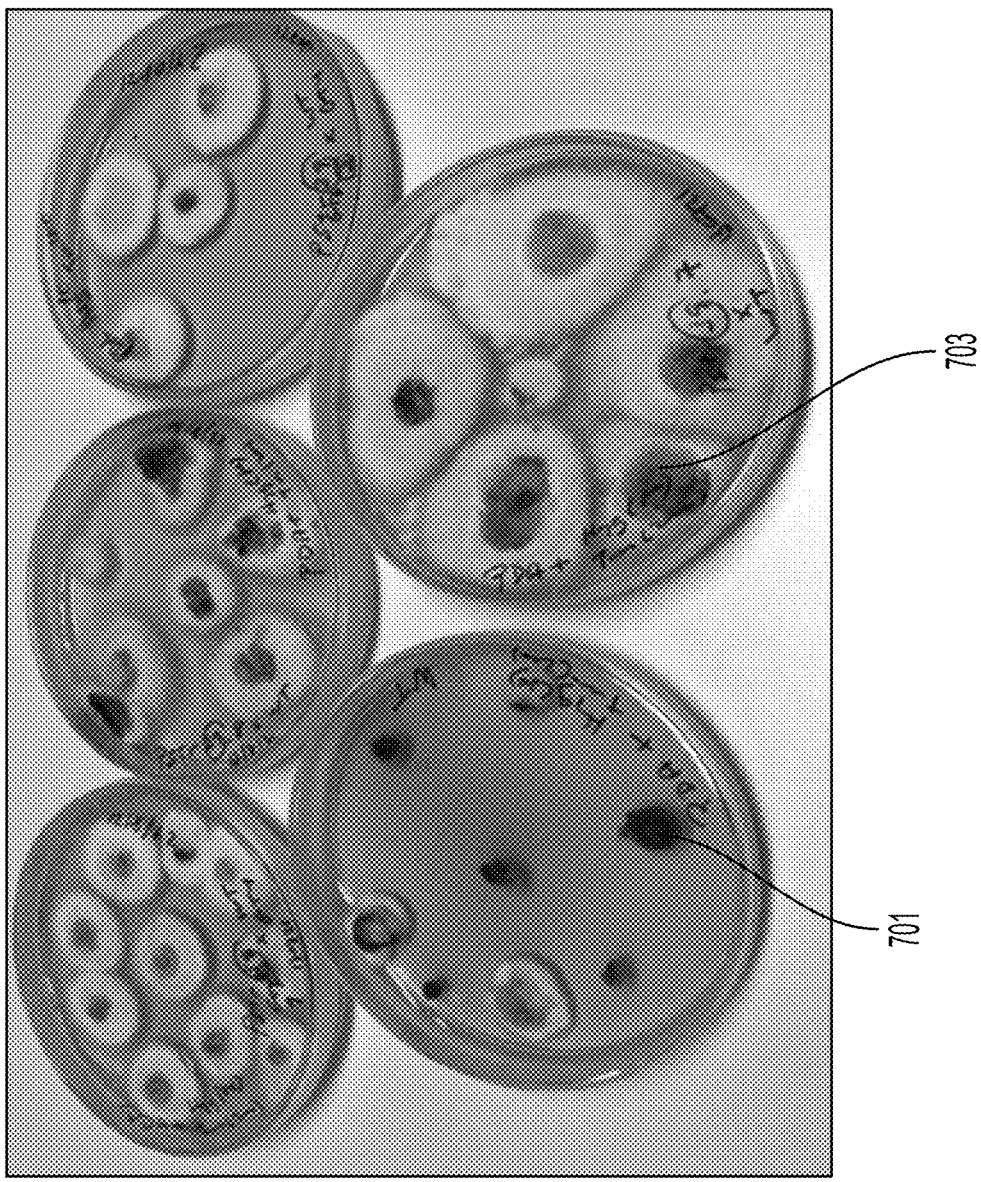
FIG. 7 is an image of non-transgenic wild-type mycelia (control) and transgenic mycelia that express elevated levels of PsiD.

FIG. 7 shows non-transgenic wild-type mycelia and transgenic mycelia that express elevated levels of PsiD. In particular, the figure shows selection plates of non-transgenic wild-type mycelia 701 and transgenic mycelia 703 that express elevated levels of PsiD. As demonstrated, the transgenic mycelia 703 exhibit a phenotype that is visually district from the comparable wild-type mycelia of the non-transgenic wild-type mycelia 701. The phenotype comprises a blue coloration that is district from the wild-type mycelia 701. The blue coloration of the transgenic mycelia 703 is illustrated in the black and white image as a different gradient of grey compared to the wild-type mycelia 701. The blue coloration is believed to be indicative of a higher concentration of psilocybin in the transgenic fungi.

The mycelia were grown into mycelial masses from which primordia were produced. In particular, genetically modified mycelia were crossed with wildtype (e.g., GT4) in cups containing casing. Each was wrapped in aluminum foil and placed in the dark at 27° C. for incubation. After 18 days, the cakes were transferred into bigger pots with vents open. For one set of the cakes, the pots were kept in the cup with wet casing, and the second set was removed from their cups with the casing on top. No pin head of the fruiting body was observed over the casing in those still inside the pots.

Figure 8:
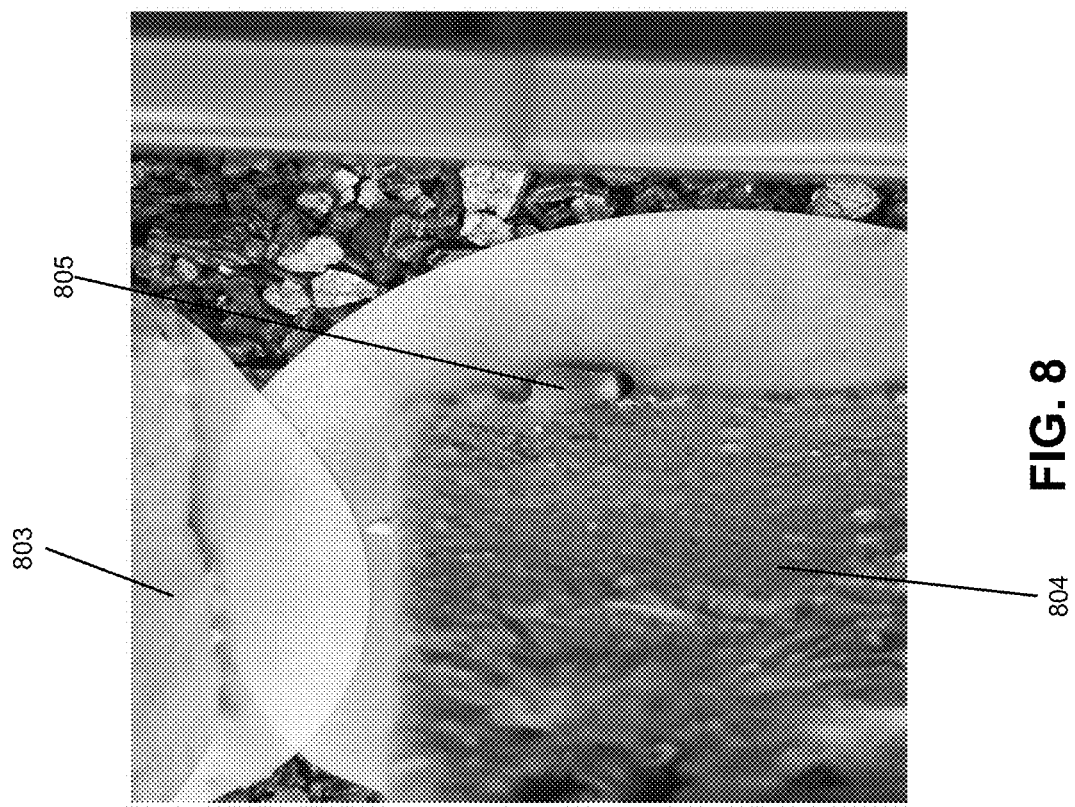
FIG. 8 shows a transgenic mycelial mass upon primordia formation.

FIG. 8 shows a transgenic mycelial mass 804 upon primordia formation 805. As discussed above, the transgenic mycelial mass 804 has a blue coloration that is distinct from a wild-type mycelia mass 803, a corner of which is illustrated in the upper left corner of the figure. The blue coloration is shown in the black and white image as a darker gradient of grey.

Dissection of the fruiting bodies and extended exposure to air produced the phenotypic tissue expression of the genetically modified sample in comparison to the unmodified fruiting body (FIG. 8).

Figure 9:
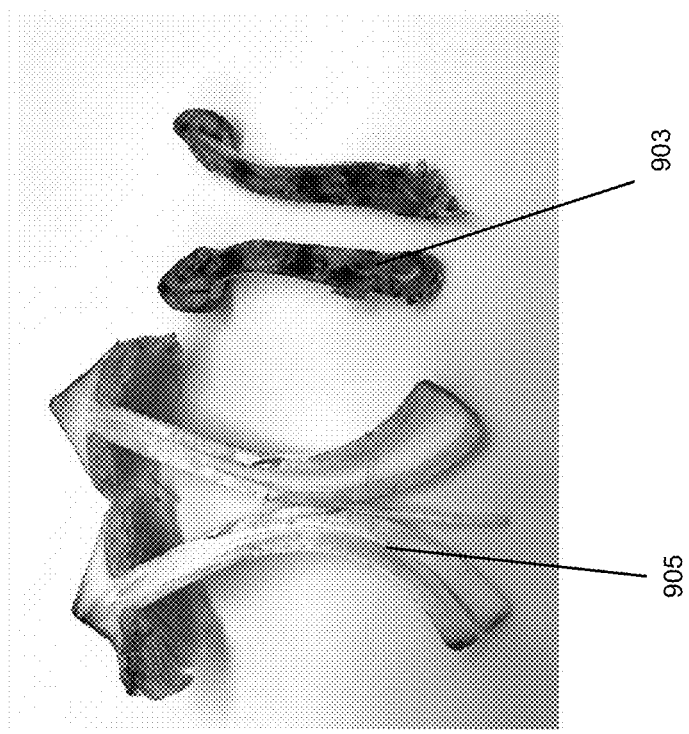
FIG. 9 shows an image of a side-by-side comparison of a PsiD transgenic fungus compared to a wild-type fungus.

FIG. 9 shows a side-by-side comparison of a PsiD transgenic fungus 903 compared to a wild-type fungus 905. The PsiD transgenic fungus comprises a blue coloration that is visibly distinct from the wild-type fungus 905. The blue coloration is suggestive of an increased quantity of psilocin in the transgenic fungus 903 as compared to the wild-type fungus 905. Since psilocin is derived from psilocybin, the transgenic fungus' phenotype (i.e., the blue coloration) suggests that the transgenic fungus has an increased amount of psilocybin as compared to the wild-type fungus 905.

Example 4. Alkaloid Analysis of Transgenic PsiD Fungi

The psilocybin content of the genetically modified mushrooms was analyzed by liquid chromatography/mass spectrometry to determine amounts of alkaloids present in the transgenic fungi. Liquid chromatography-mass spectrometry (LC-MS) is an analytical method that combines the features of liquid-chromatography and mass spectrometry to identify different substances within a test sample. To accurately assess the alkaloids, present in transgenic fungi, LC-MS analyses were conducted at two independent facilities.

To assess the alkaloid content, genetically engineered and control *P. cubensis* fungi were cultivated in the laboratory to obtain fruiting bodies. The cultured fungi were cut at the base of the stipe and freeze dried overnight before homogeneously powdered using a mortar and pestle. Both the cap and stipe were analyzed together for alkaloid content. Quantitative testing of psilocybin, psilocin, baeocystin, norbaeocystin and tryptophan, and semi-quantitative testing for Aeruginascin and Norpsilocin was performed using high performance liquid chromatography-tandem mass spectrometry (HPLC-MS/MS). For quantitative analysis, alkaloid content was compared to known concentrations of psilocybin, psilocin, baeocystin, norbaeocystin and tryptophan synthetic chemical standards.

Figure 10:
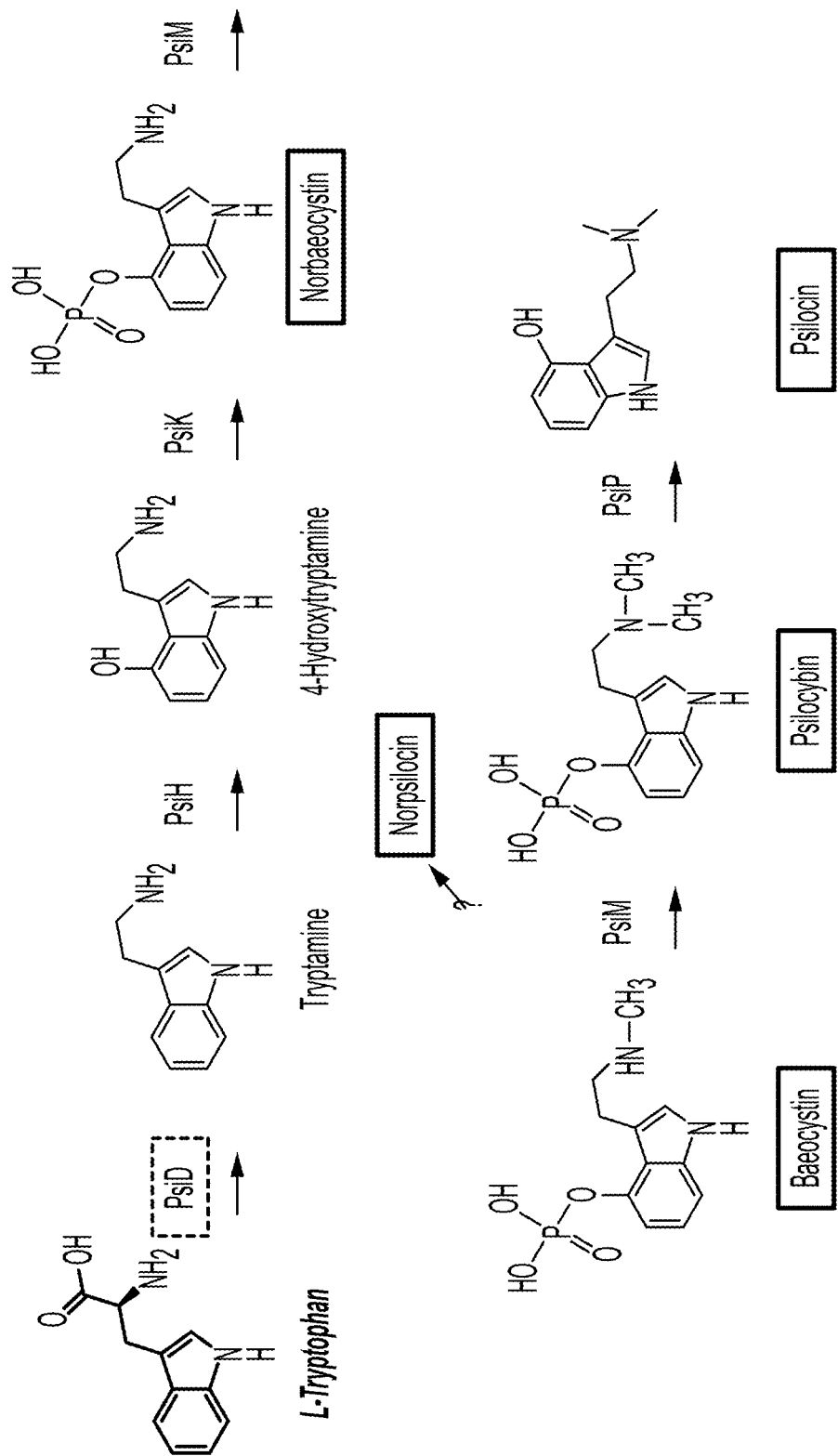
FIG. 10 illustrates a biosynthesis pathway. The pathway shows alkaloids that are upregulated upon increased expression of PsiD.

FIG. 10 shows a biosynthesis pathway with alkaloids that were identified as upregulated in the transgenic fungus as compared with a wild-type fungus devoid of a genetic modification include tryptamine, 4-hydroxytryptamine, norbaeocystin, baeocystin, norpsilocin, psilocybin, and psilocin.

Figure 11:
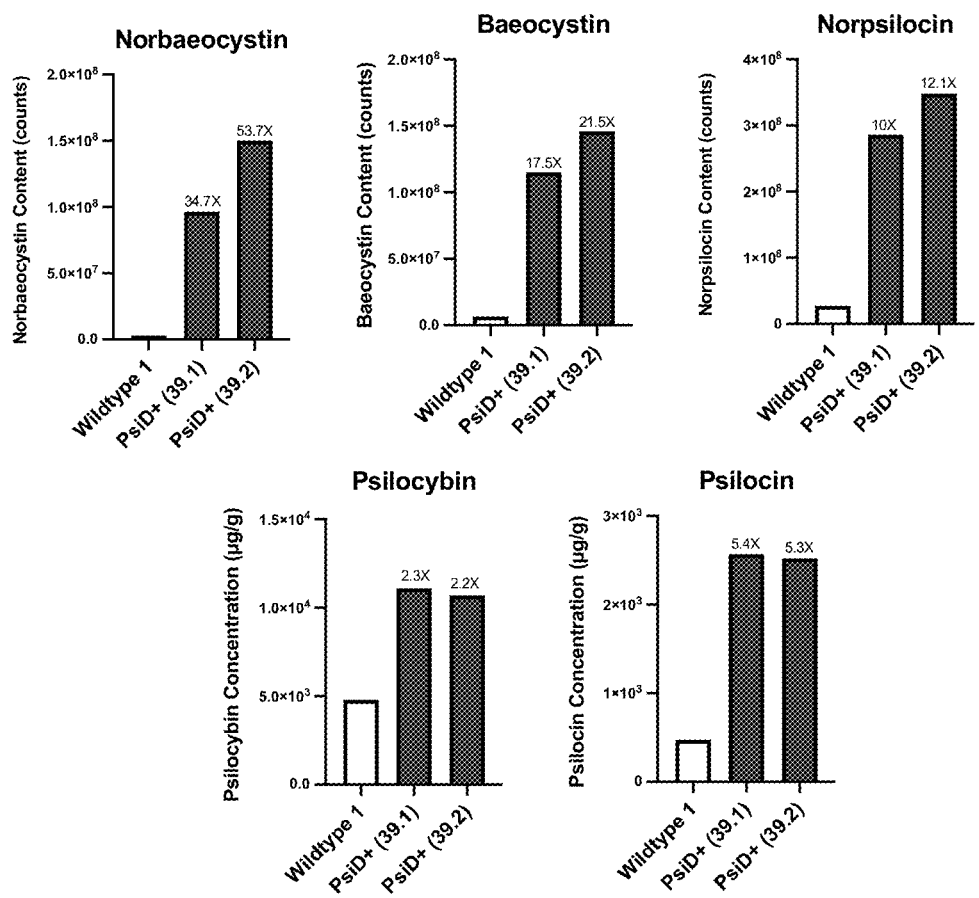
FIG. 11 shows concentrations of alkaloids measured in PsiD transgenic fungi and wild-type fungi as measured by LC-MS. The Y-axis shows area counts as detected by the LC-MS. The X-axis identifies samples.

FIG. 11 reports concentrations of alkaloids measured in PsiD transgenic and wild-type fungi. These data were collected by LC-MS. As illustrated, the data show alkaloids norbaeocystin, baeocystin, norpsilocin, psilocybin, and psilocin, are substantially upregulated as compared with a comparable wild-type fungus. Specifically, norbaeocystin is 34.7-53.7 times upregulated as compared with a comparable wild-type fungus, baeocystin is 17.5-12.5 times upregulated as compared with a comparable wild-type fungus, norpsilocin is 10-12.1 times upregulated as compared with a comparable wild-type fungus, psilocybin is 2.2-2.3 times upregulated as compared with a comparable wild-type fungus, and psilocin is 5.3-5.4 times upregulated in the PsiD transgenic fungi as compared to a comparable wild-type fungus as compared with a comparable wild-type fungus. For psilocybin and psilocin, concentrations in fungi are reported assuming a 100% recovery in ppm (µg/g). For norpsilocin, baeocystin, and norbaeocystin, data are reported as area counts detected by the LC-MS/MS. Compounds were subjected to confirmation with standards.

Figure 12:
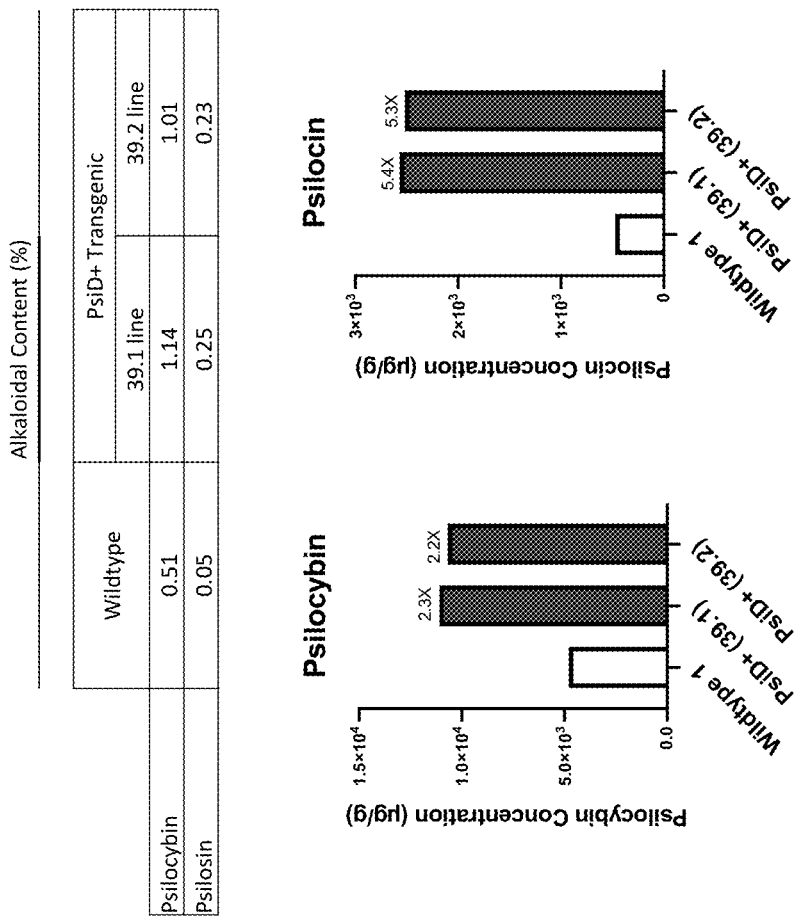
FIG. 12 shows the content of psilocybin and psilocin in PsiD transgenic fungi as compared with wild-type fungi as measured by LC-MS.
Figure 13A:
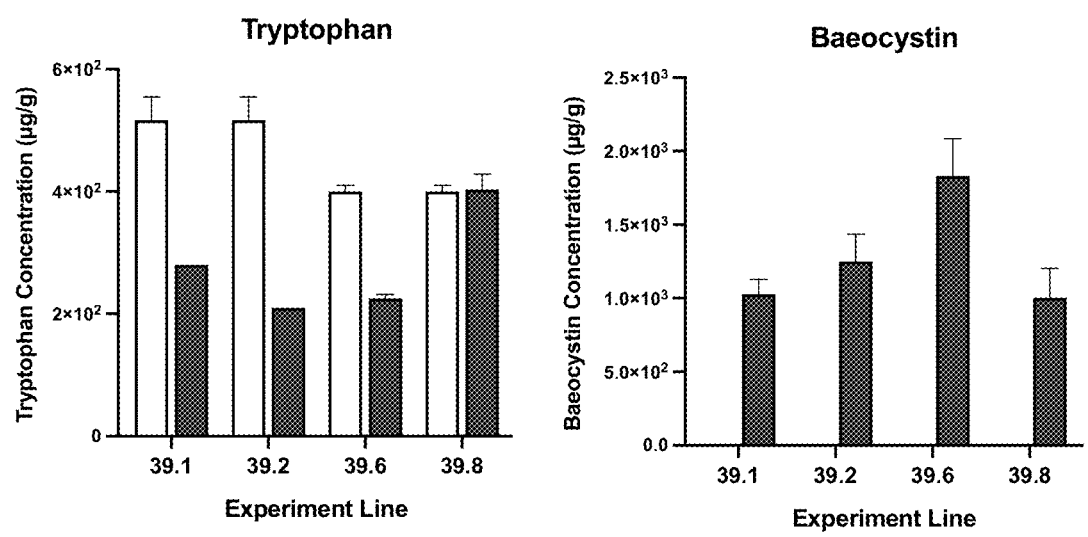
FIG. 13A-13D shows amounts of certain alkaloids measured in transgenic and wild-type fungi by LC-MS. The Y-axis shows area counts as detected by the LC-MS. The X-axis identifies samples.
Figure 13B:
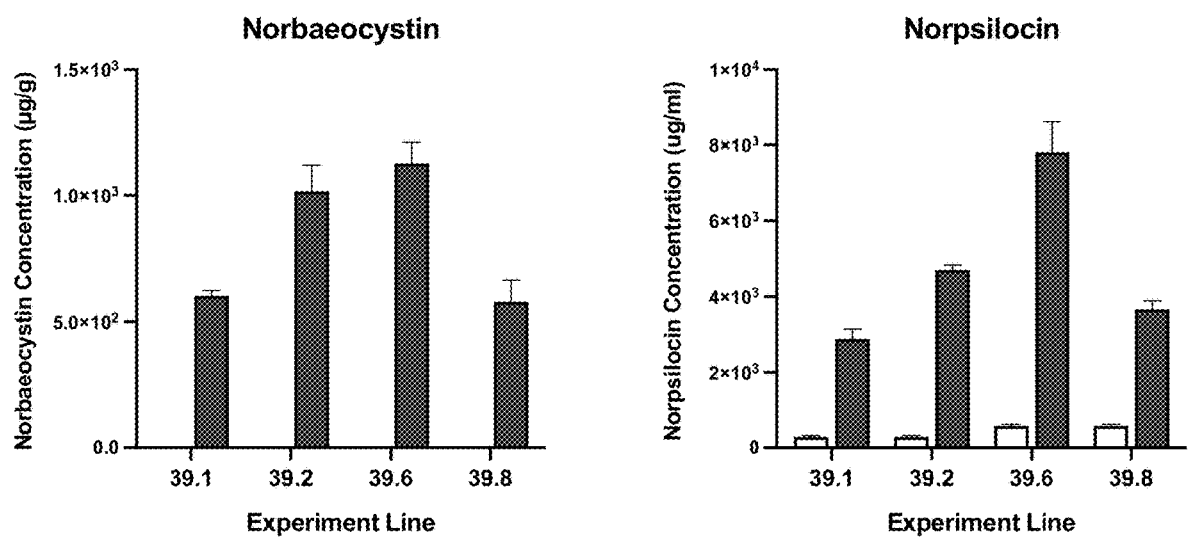
Figure 13C:
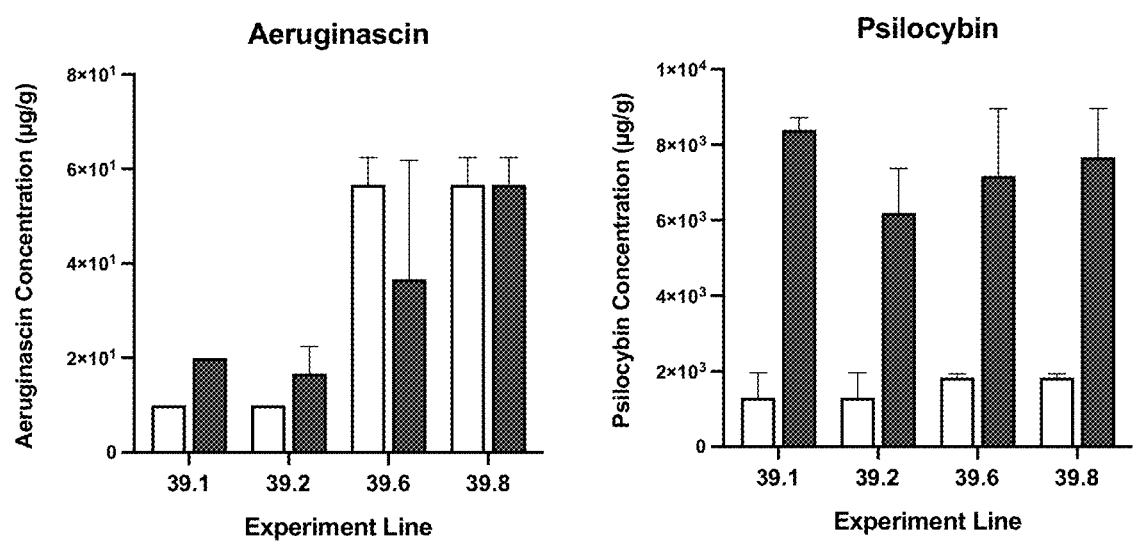
Figure 13D:
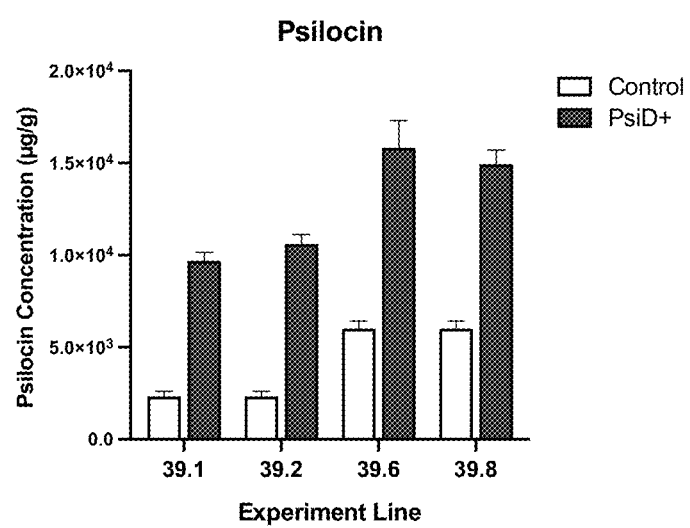

FIG. 12 shows the content of psilocybin and psilocin in PsiD transgenic fungi as compared with wild-type fungi.

FIG. 13 shows amounts of certain alkaloids measured in transgenic and wild-type fungi by LC-MS. These data were measured at a commercial facility. As illustrated, the data confirm prior results demonstrating norbaeocystin, baeocystin, norpsilocin, psilocybin, and psilocin, are present at a substantially higher amount as compared with a comparable wild-type fungus.

Figure 14:
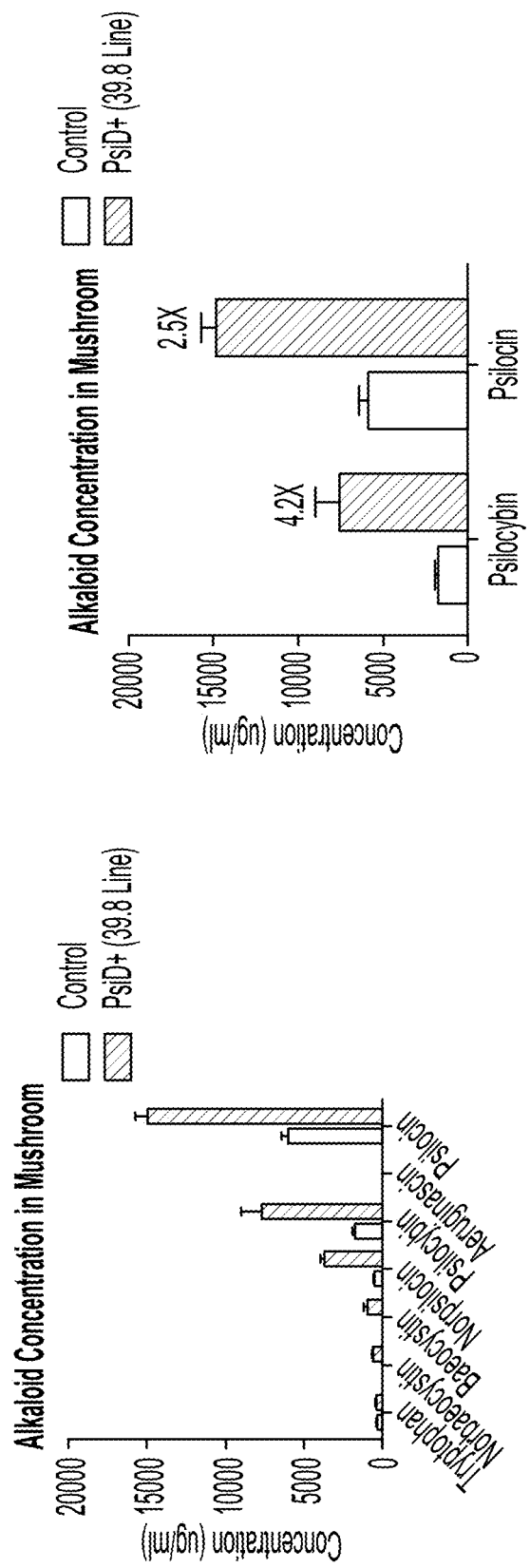
FIG. 14 shows the content of various alkaloids in the PsiD transgenic fungi as compared with wild-type fungi as measured by LC-MS.

FIG. 14 shows the content of psilocybin and psilocin in the PsiD transgenic fungi as compared with wild-type fungi. The data confirm that the genetic modification of the PsiD transgenic fungus results in at least a 4.2-fold increase in production of psilocybin and at least a 2.5-fold increase in production of psilocin as compared to a comparable wild-type fungus.

Figure 15:
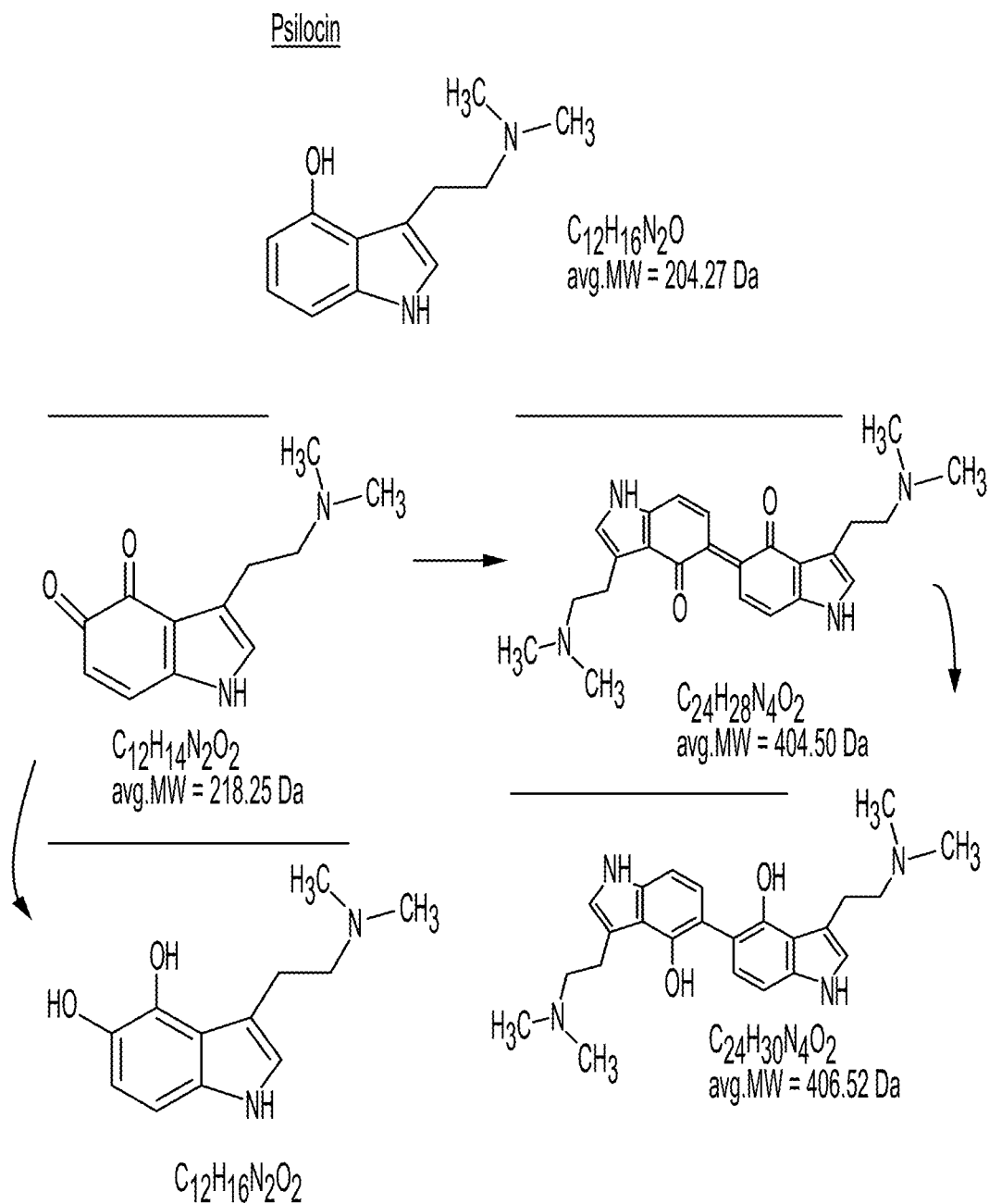
FIG. 15 illustrates certain alkaloids that are formed from psilocin.
Figure 17A:
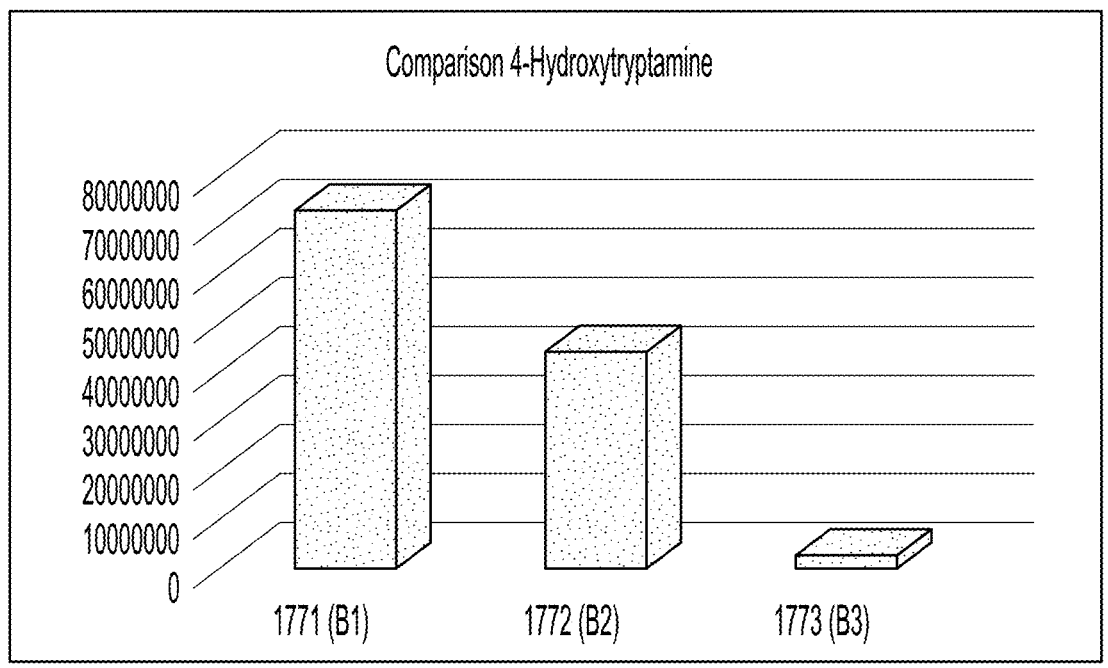
FIG. 17A through 17D shows relative amounts of alkaloids in PsiD transgenic fungi as compared with wild-type fungi. The Y axis shows area counts as detected by the LC-MS. The X-axis identifies samples. Samples 1771 and 1772 are from transgenic fungi. Sample 1773 is from a comparable wild type control.
Figure 17B:
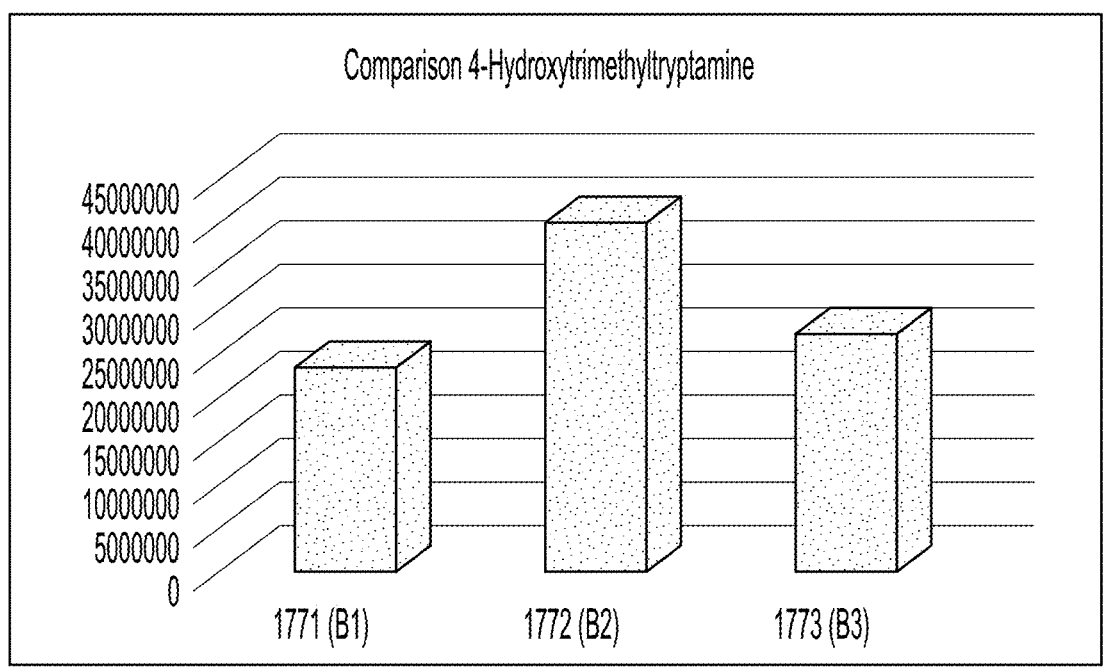
Figures 17C, 17D:
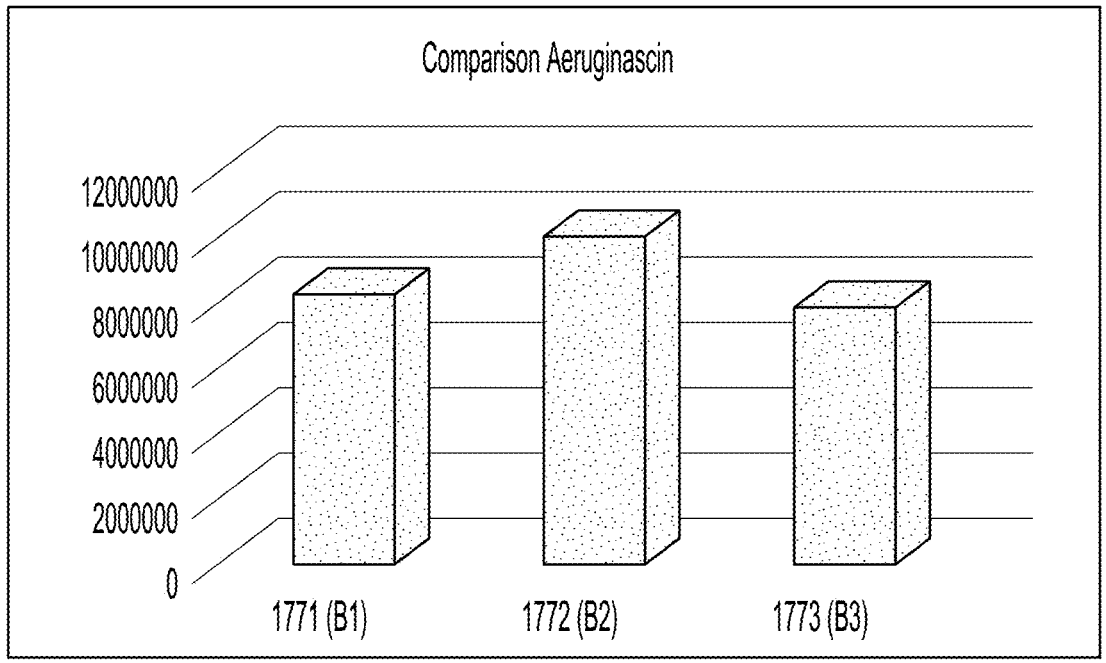

FIG. 15 illustrates alkaloids formed from psilocin. In particular, illustrated are certain alkaloids that can be formed by the oxidation of psilocin. The illustrated alkaloids include quinonoid and quinoid dimers.

FIGS. 16A and 16B are LC-MS data on quinoid and quinoid dimers as compared with psilocin from three different samples. The three samples include transgenic PsiD fungi (Nos. 1771 and 1772), and a wild type control (No. 1773). FIG. 16A reports peak areas of quinoid and quinoid dimers that enzymatically produced. FIG. 16B reports peak areas from electrospray ionization (ESI) produced product. The ESI produced quinoid and quinoid dimers are psilocin concentration dependent.

FIG. 17A-17D shows relative amounts of alkaloids in PsiD transgenic fungi as compared with wild-type fungi. In particular, the data show relative amounts of 4-hydroxytryptamine, 4-hydroxytrimethyltrypatmine, and aeurginasin as measured by LC-MS from three different samples. The samples are from transgenic PsiD fungi (sample Nos. 1771 and 1772) and wild type fungi (sample No. 1773).

Example 5. Alkaloid Analysis of Transgenic Fungi Generated by CRISPRs

The alkaloid content of the genetically modified mushrooms is analyzed by liquid chromatography/mass spectrometry to determine amounts of alkaloids present in the transgenic fungi. Liquid chromatography-mass spectrometry (LC-MS) is an analytical method that combines the features of liquid-chromatography and mass spectrometry to identify different substances within a test sample. To accurately assess the alkaloids, present in transgenic fungi, LC-MS analyses are conducted at two independent facilities.

Genetically engineered and control P. cubensis fungi are cultivated in a laboratory to obtain fruiting bodies. The cultured fungi are cut at the base of the stipe and freeze dried overnight before homogeneously powdered using a mortar and pestle. Both the cap and stipe are analysed together for alkaloid content. Quantitative testing of psilocybin, psilocin, baeocystin, norbaeocystin and tryptophan, and semi-quantitative testing for Aeruginascin and Norpsilocin are performed using high performance liquid chromatography-tandem mass spectrometry (HPLC-MS/MS). For quantitative analysis, alkaloid content is compared to known concentrations of psilocybin, psilocin, baeocystin, norbaeocystin and tryptophan synthetic chemical standards.

Alkaloids are measured in PsiD transgenic and wild-type fungi by LC-MS. Norbaeocystin is 34.7-53.7 times upregulated as compared with a comparable wild-type fungus, baeocystin is 17.5-12.5 times upregulated as compared with a comparable wild-type fungus, norpsilocin is 10-12.1 times upregulated as compared with a comparable wild-type fungus, psilocybin is 2.2-2.3 times upregulated as compared with a comparable wild-type fungus, and psilocin is 5.3-5.4 times upregulated in the PsiD transgenic fungi as compared to a comparable wild-type fungus as compared with a comparable wild-type fungus.

Example 6. Alkaloid Analysis of Transgenic Fungi Generated by CRISPRs

The alkaloid content of the genetically modified mushrooms is analyzed by liquid chromatography/mass spectrometry to determine amounts of alkaloids present in the transgenic fungi. Liquid chromatography-mass spectrometry (LC-MS) is an analytical method that combines the features of liquid-chromatography and mass spectrometry to identify different substances within a test sample. To accurately assess the alkaloids, present in transgenic fungi, LC-MS analyses are conducted at two independent facilities.

Genetically engineered and control P. cubensis fungi are cultivated in a laboratory to obtain fruiting bodies. The cultured fungi are cut at the base of the stipe and freeze dried overnight before homogeneously powdered using a mortar and pestle. Both the cap and stipe are analysed together for alkaloid content. Quantitative testing of psilocybin, psilocin, baeocystin, norbaeocystin and tryptophan, and semi-quantitative testing for Aeruginascin and Norpsilocin are performed using high performance liquid chromatography-tandem mass spectrometry (HPLC-MS/MS). For quantitative analysis, alkaloid content is compared to known concentrations of psilocybin, psilocin, baeocystin, norbaeocystin and tryptophan synthetic chemical standards.

Alkaloids are measured in PsiD transgenic and wild-type fungi by LC-MS. Norbaeocystin is 34.7-53.7 times upregulated as compared with a comparable wild-type fungus, baeocystin is 17.5-12.5 times upregulated as compared with a comparable wild-type fungus, norpsilocin is 10-12.1 times upregulated as compared with a comparable wild-type fungus, psilocybin is 2.2-2.3 times upregulated as compared with a comparable wild-type fungus, and psilocin is 5.3-5.4 times upregulated in the PsiD transgenic fungi as compared to a comparable wild-type fungus as compared with a comparable wild-type fungus.

Example 7. Engineering Transcriptional Landscape to Generate New Compounds

Transcriptional regulation is a genetic highway to acquire production capabilities for novel secondary metabolites or alter the existing biosynthesis pathways. FIG. 7 illustrates genes from the psilocybin cluster of six psilocybin-producing fungal species. The genes are coded by a gray gradient according to the annotation key provided. As illustrated, the gene order of the psilocybin cluster show discrepancies between the six psilocybin-producing species, which may be a result of genetic events such as inversions, duplications, etc., which suggests active re-arrangements and occurrences of horizontal gene transfer within in the cluster. These discrepancies suggest alternative routes of psilocybin regulation and production. All psilocybin-producing fungi contain a transcriptional regulator called PsiR within the known psilocybin cluster or elsewhere in the genome. As illustrated, Psilocybe cubensis may be genetically modified to incorporate an exogenous nucleic acid encoding one or more additional copies of PsiR 2003.

PsiR is a basic helix loop helix (bHLH) transcriptional regulator expressed in mycelium and fruiting bodies of fungi. The expression of PsiR coincides with psilocybin production. bHLH binds to DNA at a consensus hexanucleotide sequence known as an E-box CANNTG, where N is any nucleotide. Binding of the PsiR regulator to the E-Box of a gene element results in an upregulation of gene expression.

Of the psilocybin cluster genes, four (4) genes, PsiD, PsiH, PsiM, PsiT2, contain at least one E-box motif in their promoters (PsiT1 has two), whereas PsiP contains 4 E-box motifs (500 bp upstream of ATG). PsiL and PsiK do not contain the E-box motif in their upstream regions. A full transcript of PsiR is present in fruiting bodies but not in mycelium suggesting that PsiR is differentially regulated during the fungi life cycle. Induced expression of PsiR in mycelium can be used to upregulate alkaloid production at an earlier stage of the fungal life cycle.

A fungal cell is genetically modified by introducing an exogenous nucleic acid into the fungal cell, wherein the exogenous nucleic acid encodes PsiR. The exogenous nucleic acid includes a GDP promoter driving a PsiR gene (SEQ ID NOS: 7 or 14). The GDP promoter has SEQ ID NO: 30. An intron is disposed between the GDP promoter and the PsiR gene. The intron has SEQ ID NO: 31. The ectopic overexpression of PsiR upregulates the psilocybin biosynthesis pathway and also activates/upregulates other biosynthesis pathways including novel components and entourage alkaloids via targeted binding to E-box motifs.

Example 8. Quantitative Metabolite Analysis of Engineered Fungal Cells

Triplicate samples of the engineered fungal cells were extracted with methanol and submitted as powder samples to determine the alkaloid concentration by liquid Chromatography Mass Spectrometry (LCMS). The experimental samples were analyzed against analytical standards purchased commercially from Cayman Chemicals. Calibration standards, quality control (QC) solutions and blank matrix solutions with spiked analytical standards were prepared using conventional methods. Solution preparations indicating scale and concentrations are described below.

Analytical Standards

The experimental samples were analyzed against analytical standards purchased commercially from Cayman Chemicals. Stock solutions of the analytical standards of each alkaloid were prepared by diluting the solid material in anhydrous methanol (MeOH) to a concentration of 1.0 mg/mL. In the case of norbaeocystin analysis, the solid fungal material samples were diluted in a 1:1 solution of anhydrous dimethylsulfoxide (DMSO):anhydrous MeOH at a concentration of 0.5 mg/mL. Internal standard solutions were purchased as 100 μg/mL solution or prepared in water by dissolving 1 mg of each internal standard into 10 mL of water. The internal standards included psilocin-$D_{10}$ and psilocybin-D4, acquired from Merck and Cambridge Bioscience respectively. Internal standard spiking solutions were prepared as 1 mL of a 2 μg/mL solution of Psilocin-$D_{10}$ and Psilocybin-D4 in water from stock solutions (100 μg/mL). The internal MeOH extraction solvent was prepared as a 4 μg/mL of Psilocin-D10 and Psilocybin-D4 in methanol from the IS stock solutions 100 μg/mL. 10 mL of this extraction solvent is required for each 100 mg mushroom sample and 500 μL for each 5 mg sample.

Blank Matrix Extraction Samples

Cryomilled generic mushrooms (100 mg of each mushroom sample) were diluted with 10 mL anhydrous MeOH. The sample solutions underwent shaking for 10 minutes at 700 rpm, centrifuged at 4000 rpm for 4 minutes, filtered on 0.22 μm PTFE filters, and stored at −80 degrees Celsius. Calibration of quality control (QC) samples were then prepared by diluting the stored sample solutions in water (1:100).

Fungal Samples

Each experimental fungal sample was stored at −80 degrees prior to extraction. Once removed from the freezer, all samples were extracted immediately.

Sample Extraction 100 mg Scale

Mushroom extraction was carried out on a 100 mg scale. 10 mL of methanol extraction solvent was added to the powdered mushroom sample. The samples were covered in foil, underwent shaking for 10 minutes at 700 rpm, centrifuged at 4000 rpm for 4 minutes, a 1 mL aliquot of each sample was filtered on 0.22 μm PTFE filters, the filters were washed 3 times with 200 μL of MeOH and combined together in one vial. The solvent was evaporated under nitrogen gas at room temperature. The samples were reconstituted with 1 mL of a phosphate buffer (pH 7-7.3) and then diluted 100× in water prior to analysis by LCMS/MS.

Sample Extraction 5 mg Scale

Mushroom extraction was carried out on a 5 mg scale. 500 μL of methanol extraction solvent was added to the powdered mushroom sample. The samples were covered in foil, underwent shaking for 10 minutes at 700 rpm, centrifuged at 4000 rpm for 4 minutes, a 200 μL aliquot of each sample was filtered on 0.22 μm PTFE filters, the filters were washed 3 times with 200 μL of MeOH and combined together in one vial. The solvent was evaporated under nitrogen gas at room temperature. The samples were reconstituted with 200 μL of a phosphate buffer (pH 7-7.3) and then diluted 100× in water prior to analysis by LCMS/MS.

Liquid Chromatographic Conditions

The LC system used was a Waters Acquity UPLC with binary pump. A phenyl-hexyl 2×100 mm, 3 m column at 60° C. was used to separate the alkaloids. The aqueous mobile phase was 10 mM ammonium acetate, pH adjusted to 4 with acetic acid. The organic mobile phase was methanol. The gradient started at 100 organic mobile phase held for 0.2 minutes, going to 9900 organic in 1.8 minutes, held for 0.5 minutes, then returns to 10% in 0.1 minutes and then held for 0.4 minutes. Total runtime was 3 minutes. The flow rate was 0.750 m/min and 1 μL sample was injected.

Liquid Chromatographic Conditions

Positive electrospray ionization was used on a Waters TQ-XS mass spectrometer. The MRM transitions monitored were as described in TABLE 30:

TABLE 30

MRM transitions and MS abundancies for analytical alkaloid analysis

| Compound | Q1 (m/z) | Q3 (m/z) | Dwell (s) | Cone (V) | Collision (eV) |
|---|---|---|---|---|---|
| Norpsilocin | 191 | 160 | 0.050 | 19 | 18 |
| Psilocin | 205 | 160 | 0.050 | 19 | 18 |
| Norbaeocystin | 257 | 240 | 0.050 | 28 | 18 |
| Baeocystin | 271 | 191 | 0.050 | 6 | 16 |
| Psilocybin | 285 | 205 | 0.050 | 2 | 20 |
| Aeruginascin | 299 | 240 | 0.050 | 14 | 18 |
| Psilocin-d10 | 215 | 164 | 0.050 | 19 | 18 |
| Psilocybin-d4 | 289 | 209 | 0.050 | 2 | 20 |

MS methods are subject to change dependent on instrumentation

TABLE 31

Alkaloid Concentrations in Genetically Modified Fungi

| Sample | Psilocin (mg/gram) | Psilocybin (mg/gram) | Baeocystin (mg/gram) | Norbaeocystin (mg/gram) | Aeruginascin (mg/gram) | Norpsilocin (mg/gram) |
|---|---|---|---|---|---|---|
| A | 0.348 | 16.9 | 2.989 | 1.096 | 0.01782 | 0.02875 |
| A | 0.3398 | 16.54 | 2.849 | 0.9937 | 0.01608 | 0.02903 |
| A | 0.3279 | 15.45 | 2.818 | 1.019 | 0.01902 | 0.02915 |
| B | 0.3467 | 16.79 | 2.465 | 1.026 | 0.0128 | 0.03063 |

TABLE 31-continued

Alkaloid Concentrations in Genetically Modified Fungi

| Sample | Psilocin (mg/gram) | Psilocybin (mg/gram) | Baeocystin (mg/gram) | Norbaeocystin (mg/gram) | Aeruginascin (mg/gram) | Norpsilocin (mg/gram) |
|---|---|---|---|---|---|---|
| B | 0.3236 | 14.61 | 2.521 | 0.99 | 0.01253 | 0.02802 |
| B | 0.3473 | 15.29 | 2.634 | 0.9055 | 0.01284 | 0.02748 |
| C | 0.3813 | 18.79 | 3.335 | 1.106 | 0.01214 | 0.03662 |
| C | 0.3873 | 17.39 | 3.591 | 1.246 | 0.01269 | 0.03809 |
| C | 0.3916 | 18.85 | 3.919 | 1.056 | 0.01069 | 0.03443 |
| D | 0.3359 | 18.13 | 1.916 | 0.8769 | 0.02912 | 0.01649 |
| D | 0.3507 | 19.19 | 2.213 | 0.8539 | 0.03349 | 0.01682 |
| D | 0.3464 | 18.16 | 2.139 | 0.8755 | 0.03184 | 0.01651 |
| E | 0.3877 | 19.26 | 3.282 | 1.109 | 0.01918 | 0.03128 |
| E | 0.3779 | 19.42 | 3.256 | 1.164 | 0.02177 | 0.02951 |
| E | 0.3676 | 17.94 | 2.992 | 1.055 | 0.01936 | 0.0299 |
| F | 0.3309 | 15.37 | 2.234 | 0.7555 | 0.01179 | 0.02794 |
| F | 0.3365 | 15.16 | 2.461 | 0.7437 | 0.01079 | 0.0292 |
| F | 0.3339 | 14.4 | 2.425 | 0.7245 | 0.0128 | 0.02773 |
| G | 0.3134 | 14.37 | 2.702 | 0.9586 | 0.009847 | 0.03526 |
| G | 0.3077 | 12.75 | 2.487 | 0.8821 | 0.008296 | 0.03474 |
| G | 0.3173 | 13.17 | 2.811 | 0.8446 | 0.008535 | 0.0351 |

TABLE 32

Average Alkaloid Concentrations in Genetically Modified Fungi

| FS | Psilocin (mg/gram) Avg. | sd | Psilocybin (mg/gram) Avg. | sd | Baeocystin (mg/gram) Avg. | sd | Norbaeocystin (mg/gram) Avg. | sd | Aeruginascin (mg/gram) Avg. | sd | Norpsilocin (mg/gram) Avg. | sd |
|---|---|---|---|---|---|---|---|---|---|---|---|---|
| A | 0.3386 | 0.01010 | 16.2967 | 0.7550 | 2.8853 | 0.02898 | 1.03623 | 0.05328 | 0.01764 | 0.001478 | 0.02898 | 0.0002053 |
| B | 0.3392 | 0.01351 | 15.5633 | 1.1154 | 2.54 | 0.02871 | 0.9738 | 0.06186 | 0.0127 | 0.0001686 | 0.02871 | 0.001685 |
| C | 0.3867 | 0.00517 | 18.3433 | 0.8262 | 3.615 | 0.03638 | 1.136 | 0.09849 | 0.01184 | 0.001033 | 0.03638 | 0.001842 |
| D | 0.3443 | 0.00761 | 18.4933 | 0.6035 | 2.0893 | 0.01661 | 0.8688 | 0.01289 | 0.03148 | 0.002207 | 0.01661 | 0.0001850 |
| A$^s$ | 0.3777 | 0.01005 | 18.8733 | 0.8122 | 3.1767 | 0.03023 | 1.1093 | 0.05450 | 0.02010 | 0.0014462 | 0.03023 | 0.00093 |
| B$^s$ | 0.3337 | 0.002802 | 14.9767 | 0.5103 | 2.3733 | 0.02829 | 0.74123 | 0.0156 | 0.01179 | 0.00101 | 0.02829 | 0.0007951 |
| C$^s$ | 0.3128 | 0.004828 | 13.43 | 0.8407 | 2.667 | 0.0350 | 0.8951 | 0.0581 | 0.008893 | 0.0008351 | 0.0350 | 0.0002663 |

TABLE 33

Dilution Quantifications of Alkaloid Concentrations in Genetically Modified Fungi Assuming a 100% Recovery in ppm (ug/g)

| Sample Date | Samples | Sample | Psilocin in ppm (ug/g) | Psilocybin in ppm (ug/g) | Aeruginascin in ppm (ug/g) | Baeocystin in ppm (ug/g) | Norbaeocystin in ppm (ug/g) | Norpsilocin in ppm (ug/g) |
|---|---|---|---|---|---|---|---|---|
| June 27th | Aa | A | 348 | 16900 | 17.82 | 2989 | 1096 | 28.75 |
| | Ab | A | 339.8 | 16540 | 16.08 | 2849 | 993.7 | 29.03 |
| | Ac | A | 327.9 | 15450 | 19.02 | 2818 | 1019 | 29.15 |
| | Ba | B | 346.7 | 16790 | 12.8 | 2465 | 1026 | 30.63 |
| | Bb | B | 323.6 | 14610 | 12.53 | 2521 | 990 | 28.02 |
| | Bc | B | 347.3 | 15290 | 12.84 | 2634 | 905.5 | 27.48 |
| | Ca | C | 381.3 | 18790 | 12.14 | 3335 | 1106 | 36.62 |
| | Cb | C | 387.3 | 17390 | 12.69 | 3591 | 1246 | 38.09 |
| | Cc | C | 391.6 | 18850 | 10.69 | 3919 | 1056 | 34.43 |
| | Da | D | 335.9 | 18130 | 29.12 | 1916 | 876.9 | 16.49 |
| | Db | D | 350.7 | 19190 | 33.49 | 2213 | 853.9 | 16.82 |
| | Dc | D | 346.4 | 18160 | 31.84 | 2139 | 875.5 | 16.51 |
| | Ea | E | 387.7 | 19260 | 19.18 | 3282 | 1109 | 31.28 |
| | Eb | E | 377.9 | 19420 | 21.77 | 3256 | 1164 | 29.51 |
| | Ec | E | 367.6 | 17940 | 19.36 | 2992 | 1055 | 29.9 |
| | Fa | F | 330.9 | 15370 | 11.79 | 2234 | 755.5 | 27.94 |
| | Fb | F | 336.5 | 15160 | 10.79 | 2461 | 743.7 | 29.2 |
| | Fc | F | 333.9 | 14400 | 12.8 | 2425 | 724.5 | 27.73 |
| | Ga | G | 313.4 | 14370 | 9.847 | 2702 | 958.6 | 35.26 |
| | Gb | G | 307.7 | 12750 | 8.296 | 2487 | 882.1 | 34.74 |
| | Gc | G | 317.3 | 13170 | 8.535 | 2811 | 844.6 | 35.1 |
| | Dilution used | | dilution 1:100 | dilution 1:1000 | dilution 1:10 | dilution 1:1000 | dilution 1:1000 | dilution 1:10 |

TABLE 33-continued

Dilution Quantifications of Alkaloid Concentrations in Genetically Modified Fungi
Assuming a 100% Recovery in ppm (ug/g)

| Sample Date | Samples | Sample | Psilocin in ppm (ug/g) | Psilocybin in ppm (ug/g) | Aeruginascin in ppm (ug/g) | Baeocystin in ppm (ug/g) | Norbaeocystin in ppm (ug/g) | Norpsilocin in ppm (ug/g) |
|---|---|---|---|---|---|---|---|---|
| | | | | except H at 1:10 | | except H no dilution | no dilution for H | except H no dilution |

ND: Not detected even at a dilution of 1:10.

Example 9. Engineering Transcriptional Landscape to Generate New Compounds

Transcriptional regulation is a genetic highway to acquire production capabilities for novel secondary metabolites or alter the existing biosynthesis pathways.

FIG. 7 illustrates genes from the psilocybin cluster of six psilocybin-producing fungal species. The genes are coded by a gray gradient according to the annotation key provided. As illustrated, the gene order of the psilocybin cluster show discrepancies between the six psilocybin-producing species, which may be a result of genetic events such as inversions, duplications, etc., which suggests active re-arrangements and occurrences of horizontal gene transfer within in the cluster. These discrepancies suggest alternative routes of psilocybin regulation and production. All psilocybin-producing fungi contain a transcriptional regulator called PsiR within the known psilocybin cluster or elsewhere in the genome. As illustrated, *Psilocybe cubensis* may be genetically modified to incorporate an exogenous nucleic acid encoding one or more additional copies of PsiR 2003.

PsiR is a basic helix loop helix (bHLH) transcriptional regulator expressed in mycelium and fruiting bodies of fungi. The expression of PsiR coincides with psilocybin production. bHLH binds to DNA at a consensus hexanucleotide sequence known as an E-box CANNTG, where N is any nucleotide. Binding of the PsiR regulator to the E-Box of a gene element results in an upregulation of gene expression.

Of the psilocybin cluster genes, four (4) genes, PsiD, PsiH, PsiM, PsiT2, contain at least one E-box motif in their promoters (PsiT1 has two), whereas PsiP contains 4 E-box motifs (500 bp upstream of ATG). PsiL and PsiK do not contain the E-box motif in their upstream regions. A full transcript of PsiR is present in fruiting bodies but not in mycelium suggesting that PsiR is differentially regulated during the fungi life cycle. Induced expression of PsiR in mycelium can be used to upregulate alkaloid production at an earlier stage of the fungal life cycle.

A fungal cell is genetically modified by introducing an exogenous nucleic acid into the fungal cell, wherein the exogenous nucleic acid encodes PsiR. The exogenous nucleic acid includes a GDP promoter driving a PsiR gene (SEQ ID NOS: 7 or 14). The GDP promoter has SEQ ID NO: 30. An intron is disposed between the GDP promoter and the PsiR gene. The intron has SEQ ID NO: 31. The ectopic overexpression of PsiR upregulates the psilocybin biosynthesis pathway and also activates/upregulates other biosynthesis pathways including novel components and entourage alkaloids via targeted binding to E-box motifs.

Example 10. Alkaloidal Content of PsiD Transgenic Fungi

The psilocybin content of the genetically modified mushrooms was analyzed by liquid chromatography/mass spectrometry to determine amounts of alkaloids present in the transgenic fungi. Liquid chromatography-mass spectrometry (LC-MS) is an analytical method that combines the features of liquid-chromatography and mass spectrometry to identify different substances within a test sample. To assess the alkaloids, present in transgenic fungi, LC-MS analyses were conducted at two independent facilities.

Briefly, fruiting bodies of transgenic fungi and non-transgenic fungi were dissected and transferred to 50 mL falcon tubes and snap frozen in liquid nitrogen. Wet weight was measured and samples were maintained at −80 degrees Celsius. Samples were desiccated in a freeze drier at −45 degrees Celsius at 0.05 bar for 24 hours. The freeze-dried samples were then ground to a fine powder at room temperature using a mortar and pestle. Ground samples were transferred to a 50 mL tube and dry weight was measured. 7.1 grams of dry ground sample were transferred to a subsequent set of 50 mL tubes and sent for analysis.

FIG. 12 shows a biosynthesis pathway of alkaloids downstream from PsiD that were identified as upregulated in the transgenic fungus as compared with a wild-type fungus devoid of a genetic modification. The upregulated alkaloids included tryptamine, 4-hydroxytryptamine, norbaeocystin, baeocystin, norpsilocin, psilocybin, and psilocin.

FIG. 13 shows graphs of concentrations of alkaloids measured in PsiD transgenic and wild-type fungi. As illustrated, the data show alkaloids norbaeocystin, baeocystin, norpsilocin, psilocybin, and psilocin, are substantially upregulated as compared with a comparable wild-type fungus. Specifically, norbaeocystin is 34.7-53.7 times upregulated as compared with a comparable wild-type fungus, baeocystin is 17.5-12.5 times upregulated as compared with a comparable wild-type fungus, norpsilocin is 10-12.1 times upregulated as compared with a comparable wild-type fungus, psilocybin is 2.2-2.3 times upregulated as compared with a comparable wild-type fungus, and psilocin is 5.3-5.4 times upregulated in the PsiD transgenic fungi as compared to a comparable wild-type fungus as compared with a comparable wild-type fungus. For psilocybin and psilocin, concentrations in fungi are reported assuming a 100% recovery in ppm (µg/g). For norpsilocin, baeocystin, and norbaeocystin, data are reported as area counts detected by the LC-MS/MS. Compounds were subjected to confirmation with standards.

FIG. 14 shows the content of psilocybin and psilocin in PsiD transgenic fungi as compared with wild-type fungi.

FIG. 15 shows amounts of certain alkaloids measured in transgenic and wild-type fungi by LC-MS. As illustrated, the data confirm prior results demonstrating norbaeocystin, baeocystin, norpsilocin, psilocybin, and psilocin, are present at a substantially higher amount as compared with a comparable wild-type fungus.

FIG. 16 shows the content of psilocybin and psilocin in the PsiD transgenic fungi as compared with wild-type fungi.

The data confirm that the genetic modification of the PsiD transgenic fungus results in at least a 4.2-fold increase in production of psilocybin and at least a 2.5-fold increase in production of psilocin as compared to a comparable wild-type fungus.

FIG. 17 illustrates alkaloids formed from psilocin. In particular, illustrated are certain alkaloids that can be formed by the oxidation of psilocin. The illustrated alkaloids include quinonoid and quinoid dimers.

Figure 18A:
FIG. 18A through 18C shows genetically modified fungal cells with the phenotypic blue coloration.
Figure 18B:
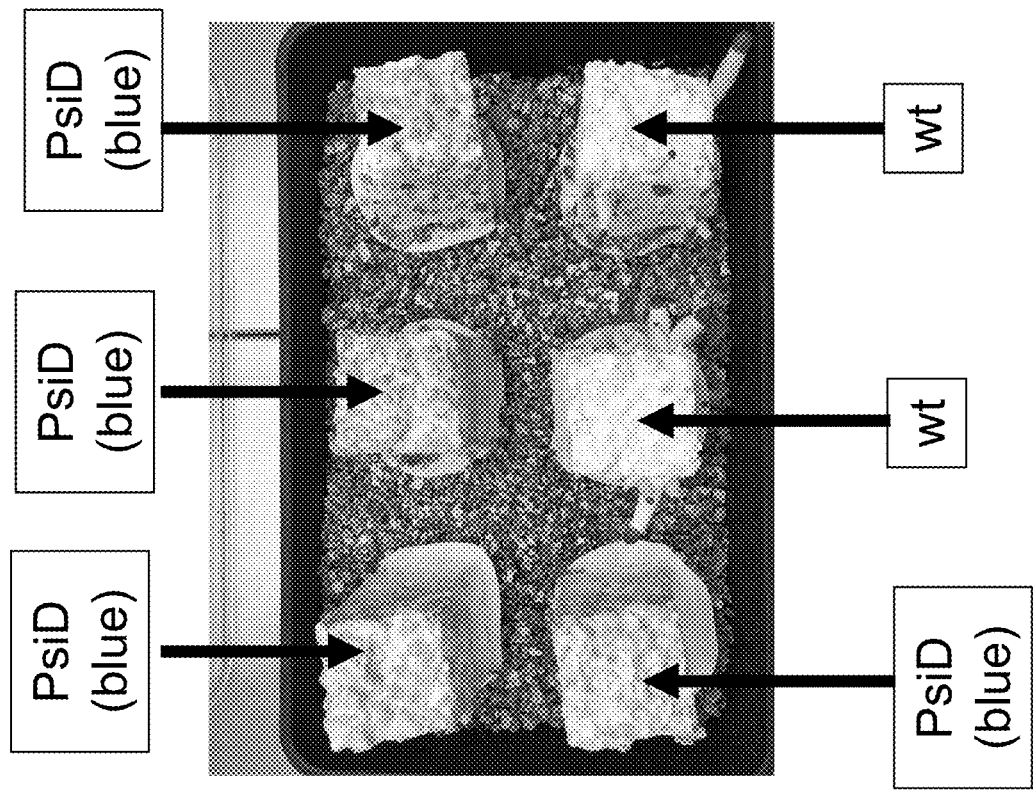
Figure 18C:

FIGS. 18A and 18B are LC-MS data on quinoid and quinoid dimers as compared with psilocin from three different samples. The three samples include transgenic PsiD fungi (Nos. 1771 and 1772), and a wild type control (No. 1773). FIG. 18A reports peak areas of quinoid and quinoid dimers that enzymatically produced. FIG. 18B reports peak areas from electrospray ionization (ESI) produced product. The ESI produced quinoid and quinoid dimers are psilocin concentration dependent.

FIGS. 19A-19D shows relative amounts of alkaloids in PsiD transgenic fungi as compared with wild-type fungi. In particular, the data show relative amounts of 4-hydroxytryptamine, 4-hydroxytrimethyltrypatmine, and aeurginasin as measured by LC-MS from three different samples. The samples are from transgenic PsiD fungi (sample Nos. 1771 and 1772) and wild type fungi (sample No. 1773).

Example 11. Genetically Engineered Reduction of Psilocybin Degradation Products

To increase production of a bioactive compound, e.g., psilocybin, the bioactive compound is produced simultaneously with an inhibitor of its own degradation, thereby increasing the overall production of the bioactive compound. An enzyme that produces a 3-carboline core is overexpressed in *Psilocybe cubensis* to enhance production of bioactive compounds.

β-carbolines are neuroactive compounds that inhibit monoamine oxidases which degrade psilocybin in human body. They are present in *P. cubensis* (i.e., *harmala* alkaloids such as harmane and harmine) but at very low amounts (around 0.2 µg/g). They are part of entourage in *Psilocybe* to prevent psilocybin degradation in human body.

Figure 21A:
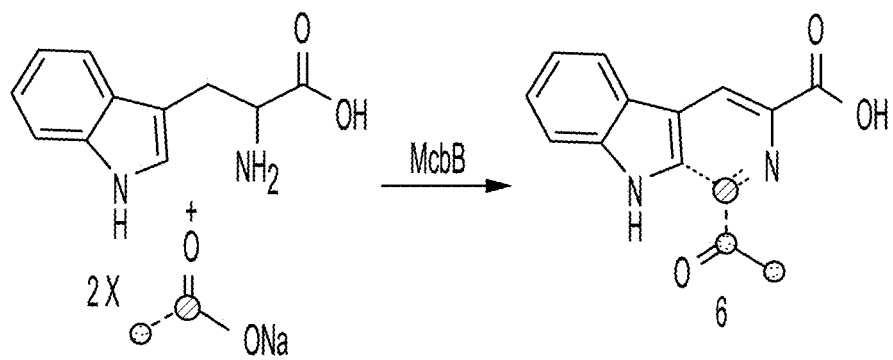
FIGS. 21A and 21B show β-carboline biosynthesis pathways. β-carboline core construction requires a Pictet-Spengler cyclization process.
Figure 21B:
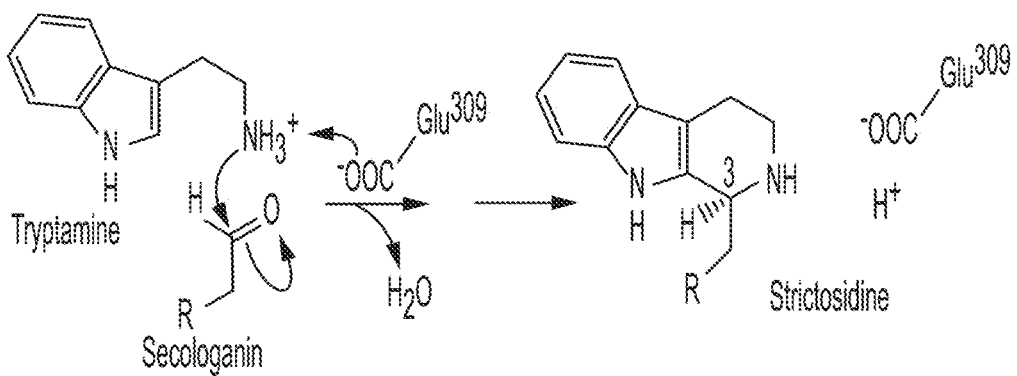

FIGS. 21A and 21B shows β-carbolines biosynthesis pathways. β-carboline core construction requires a Pictet-Spengler cyclization process. FIG. 21A shows a pathway from bacteria, which is used to produce a β-carboline scaffold from L-tryptophan. FIG. 21B shows a related pathway from a plant, which involves condensation of tryptamine and secologanin to produce a tetrahydro-β-carboline compound.

The β-carbolines biosynthesis pathway diverged from the same building block (Trp) as psilocybin but produces dissimilar compounds; yet contribute to the same pharmacological effects. *Harmala* alkaloids are also found in the *Banisteriopsis caapi* vine, the key plant ingredient in the sacramental beverage Ayahuasca.

An enzyme that produces a β-carboline core is overexpressed in *Psilocybe cubensis* to enhance production of bioactive compounds. The enzyme is encoded by a bacterial gene, McbB gene, which has SEQ ID NO: 126. To induce expression of the McbB gene ins a fungal cell, the gene is driven by a GDP promoter with SEQ ID NO: 31. The induced expression of the McbB gene the fungal cell leads to production of a useful alkaloid, DMT (N, N-Dimethyl-tryptamine), which when delivered to patients suffering from mental health disorder results in reduced symptoms.

Additional transgenic fungi are genetically modified to induce expression of a plant enzyme that produces β-carboline in *Psilocybe cubensis*. This can result in the enhanced production of DMT, which is found in some plant species. The enzyme is encoded by the plant gene, strictosidine synthase (STST) from *Catharanthus roseus*, which has SEQ ID NO: 125. Induced expression of the STST gene leads to production of DMT in the fungal cell.

Example 12. Engineering DMTP in *Psilocybe*

*Psilocybe cubensis* is genetically modified to produce DMT. DMT is found in several plants and is one of the active ingredients in Ayahuasca. DMTP (N,N,dimethyl-L-tryptophan) can be decarboxylated metabolically into DMT after ingestion through the action of aromatic L-amino acid decarboxylase (AAAD). This disclosure includes the discovery that PsTrpM, and in particular, PsTrpM from *Psilocybe serbica*. This can be used to produce DMT in a genetically modified *Psilocybe cubensis*.

Figure 22:
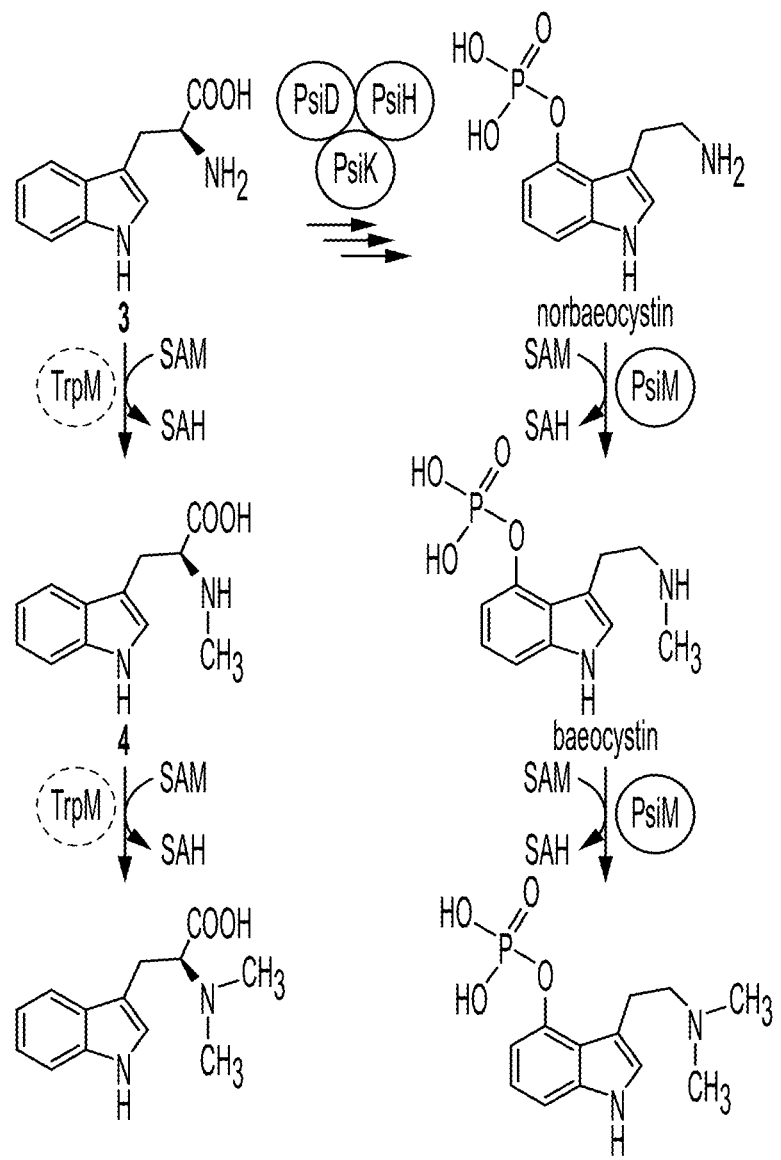
FIG. 22 illustrates methyl transfer steps during biosynthesis of N,N-dimethyl-L-tryptophan and psilocybin by TrpM and PsiM, respectively.
Figure 25:
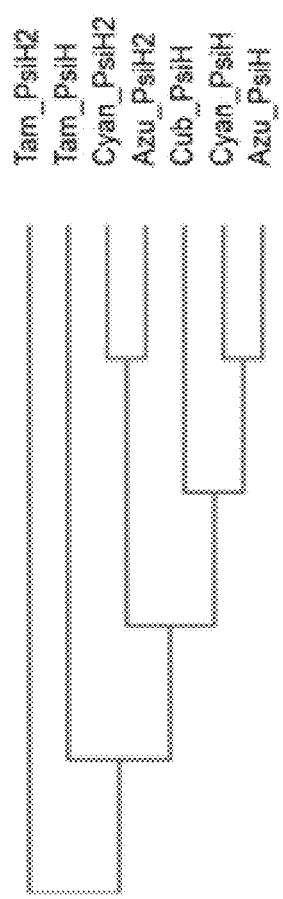
FIG. 25 shows a phylogenetic tree generated for PsiH and PsiH2 genes from four psilocybin producing fungi.
Figure 26:
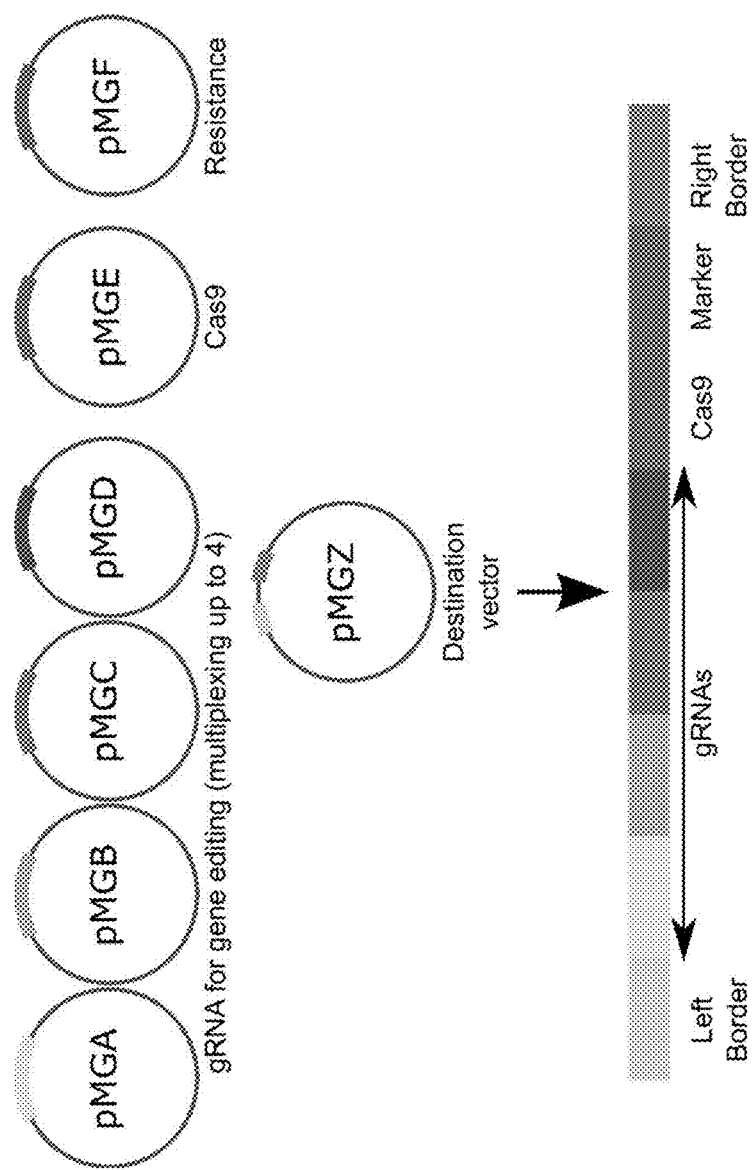
FIG. 26 is a schematic representation of a cloning system used for genetic engineering.
Figure 29A:
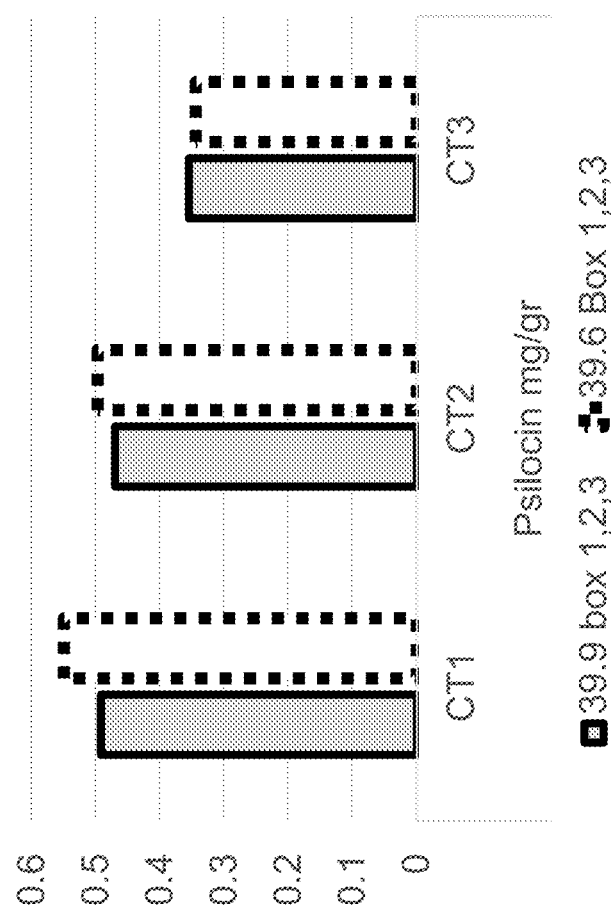
FIG. 29A-29F shows analytical analyses of optimized genetically engineered fungi for two strains (39.9 and 39.6) with analyses run in triplicate.
Figure 29B:
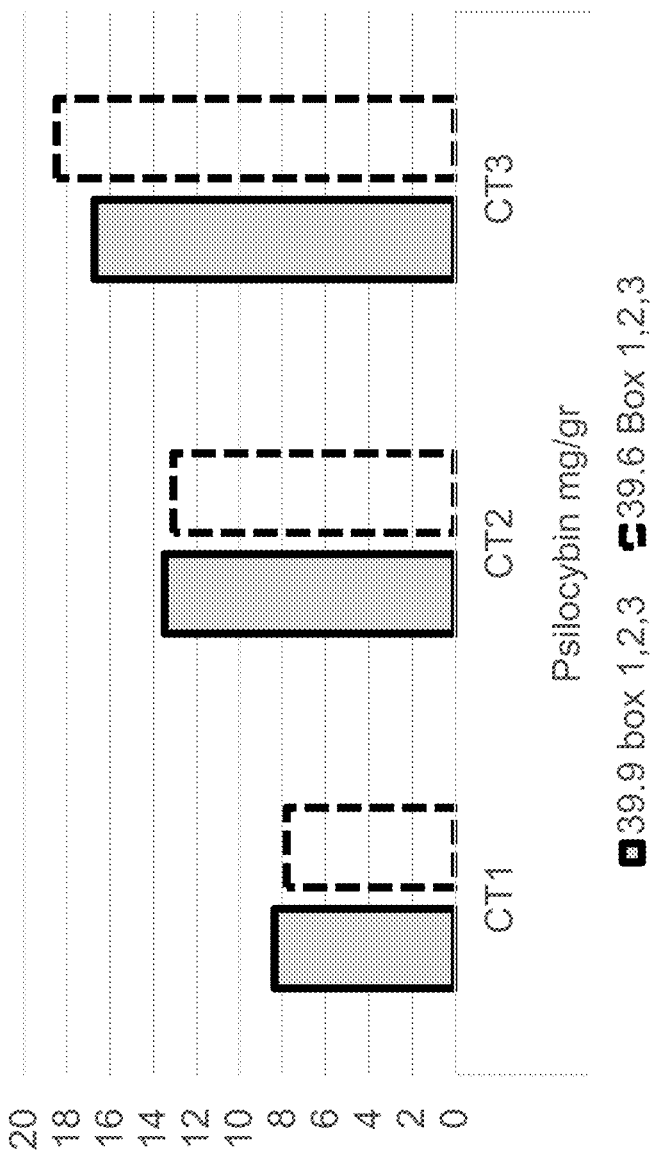
Figure 29C:
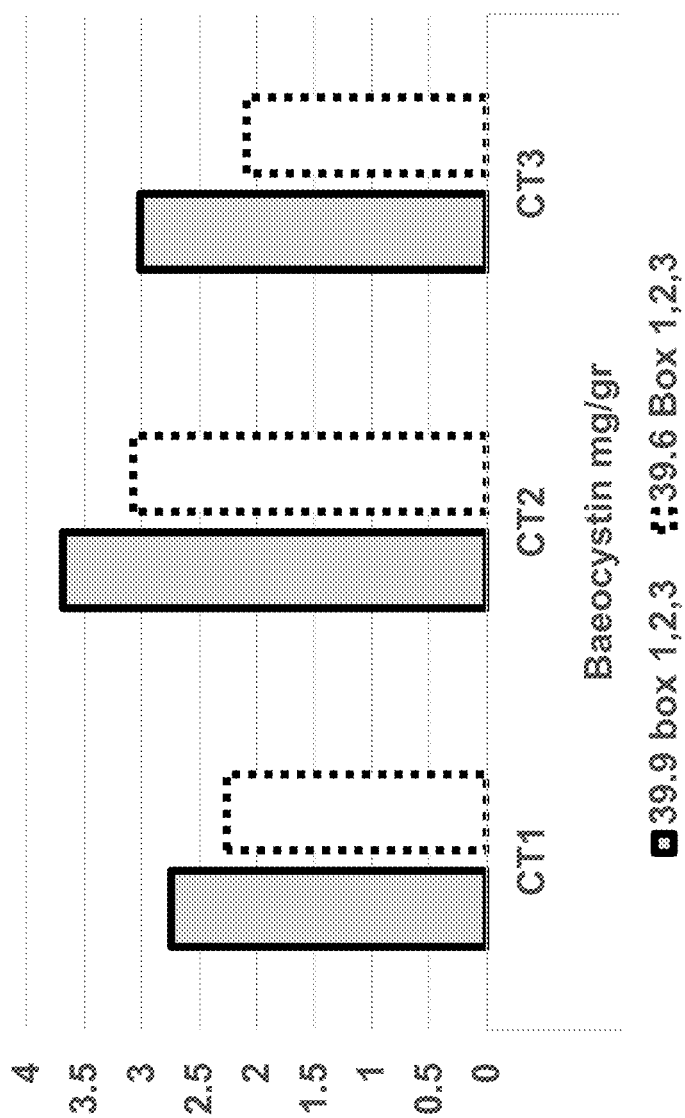
Figure 29D:
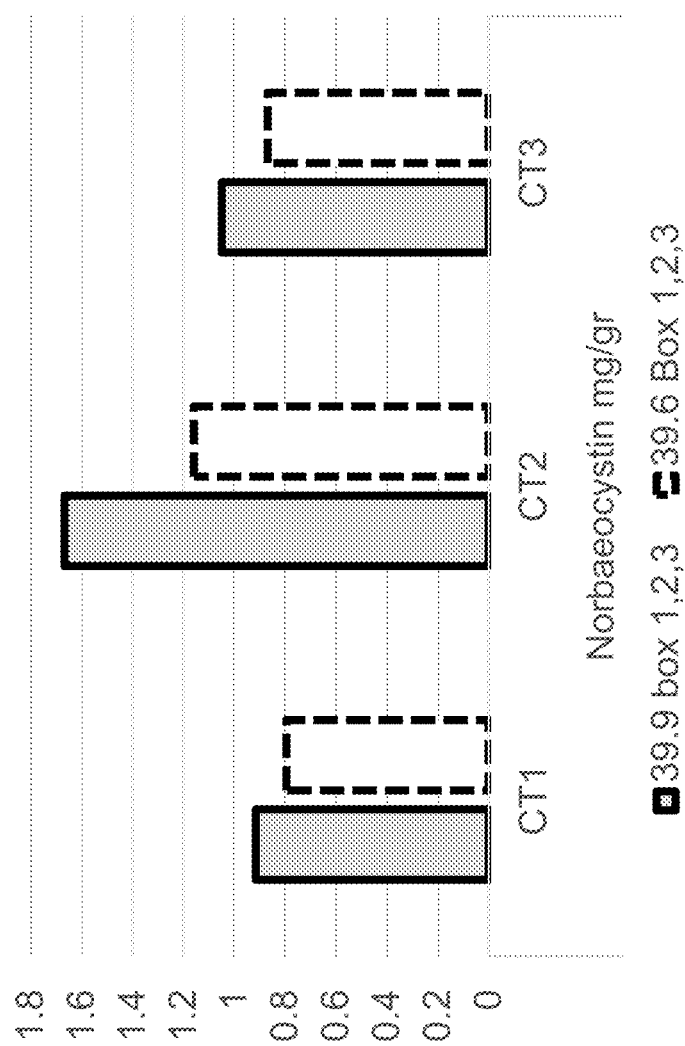
Figure 29E:
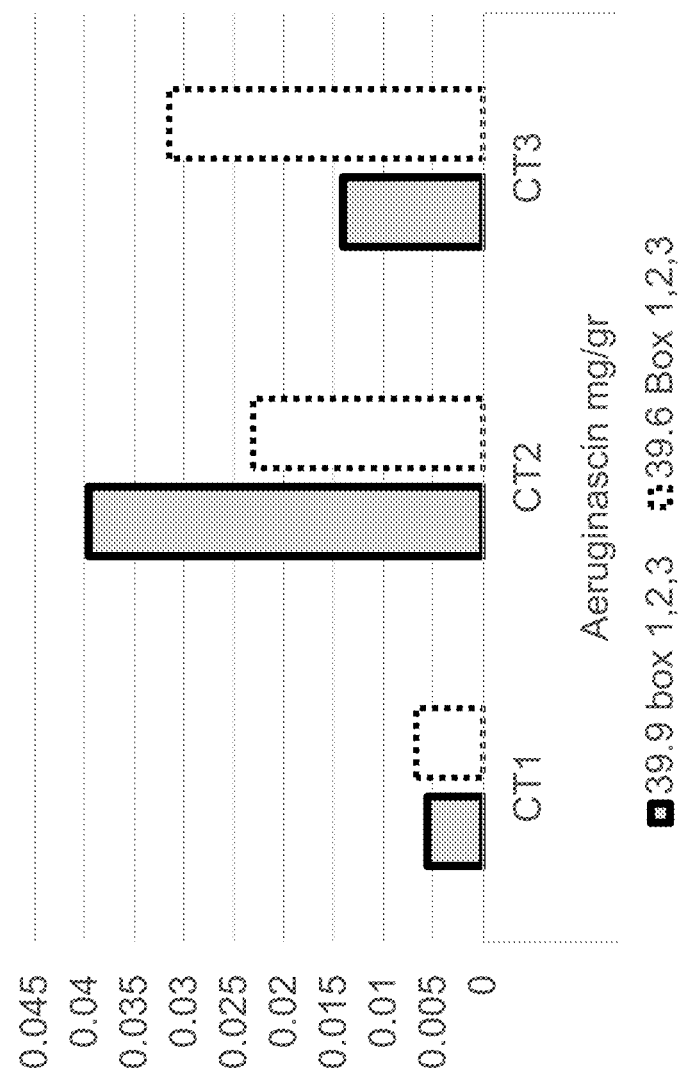
Figure 29F:
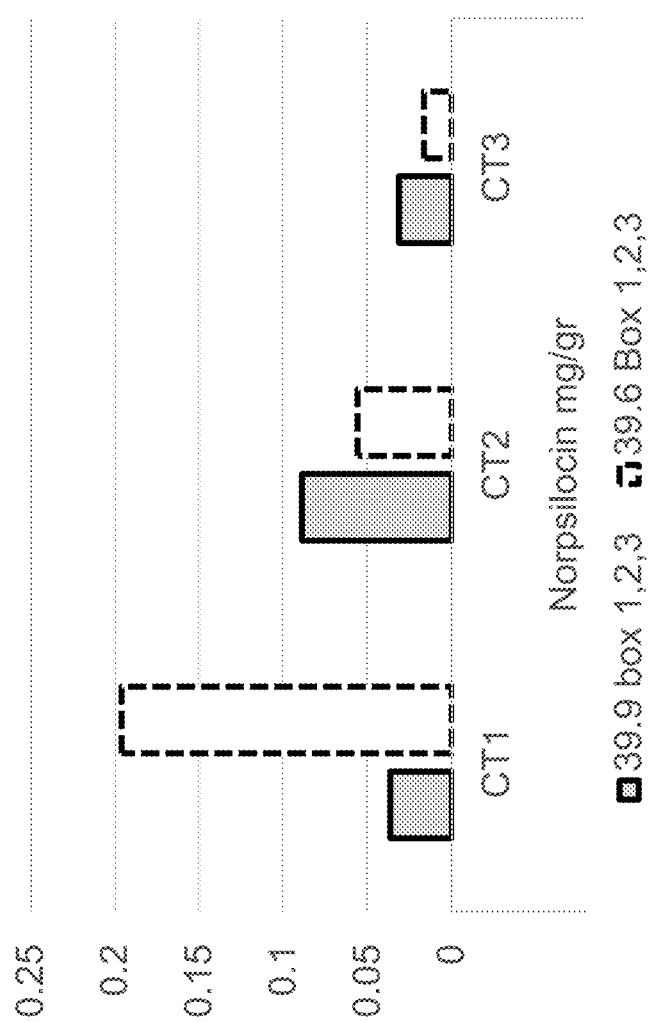
Figure 30A:
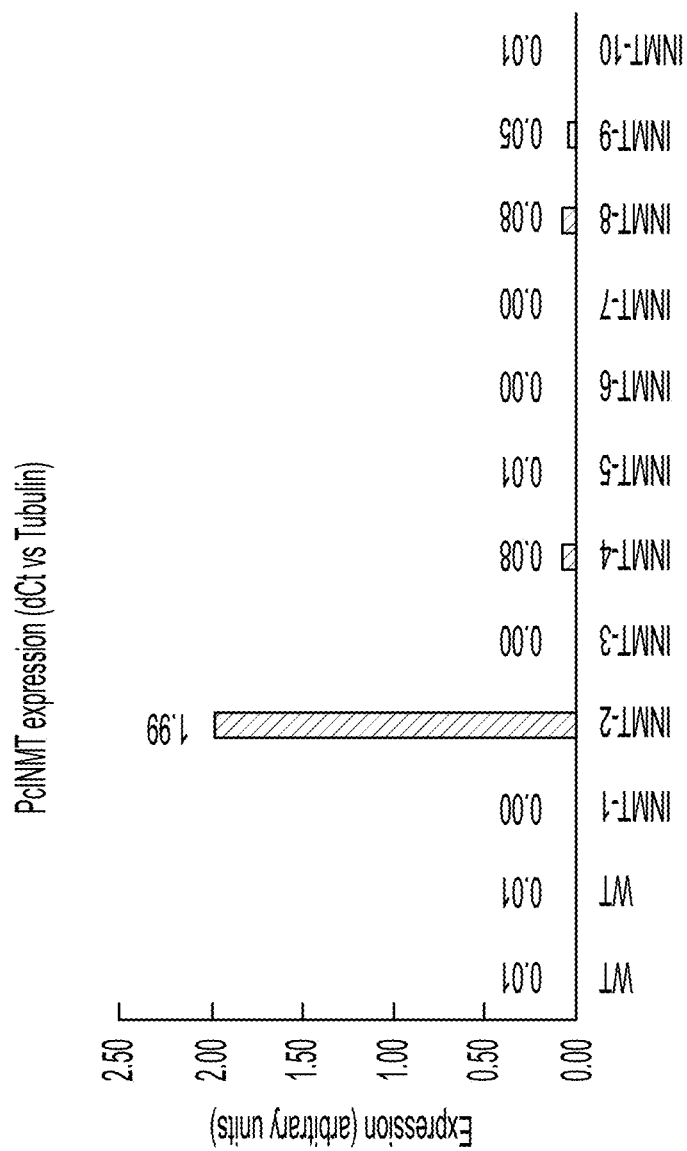
FIG. 30A-30B show graphical representations of *Psilocybe cubensis* INMT (PcINMT) expression using a PcINMT plasmid optimized for *Psilocybe cubensis* in 24 independent cell lines transformed in genetically engineered mycelium. Expression was measured in arbitrary units.
Figure 30B:
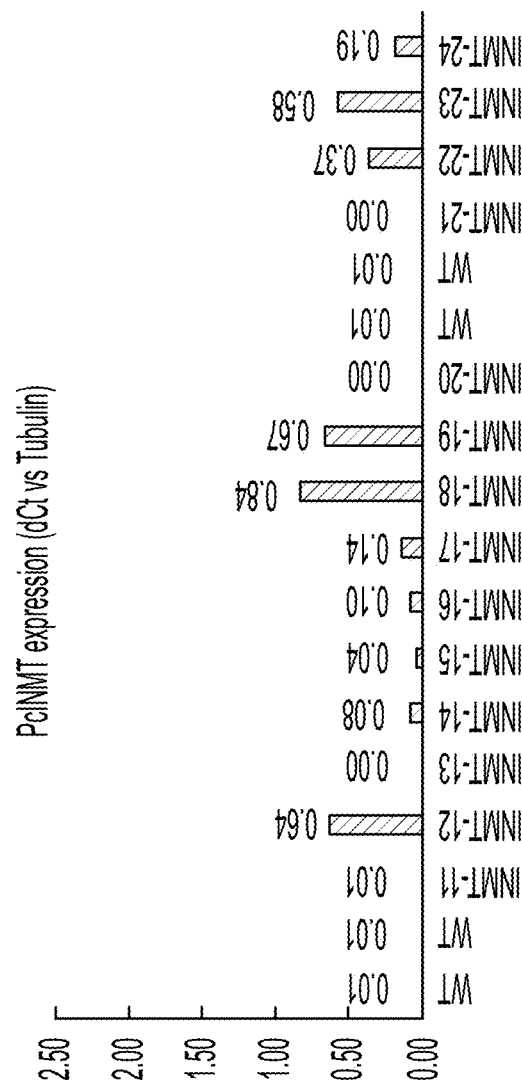

FIG. 22 illustrates the methyl transfer steps of TrpM and PsiM during biosynthetic pathways to N,N-dimethyl-L-tryptophan and psilocybin, respectively. TrpM originates from a retained ancient duplication event of a portion of the egtDB gene (latter required for ergothioneine biosynthesis and processively trimethylates L-histidine), and is phylogenetically unrelated to PsiM.

The TrpM gene from the fungus *Psilocybe serbica* is introduced into *Psilocybe cubensis* on an exogenous nucleic acid. The gene comprises SEQ ID NO: 124, which is driven by a GDP promoter, SEQ ID NO: 30. By expressing the TrpM from the exogenous nucleic acid inside *Psilocybe cubensis*, DMT is produced. The genetically modified *Psilocybe cubensis* fungus can further be modified to, e.g., produce increased amounts of L-tryptophan (e.g., introducing an exogenous nucleic acid encoding PsiD), or down-regulate enzymatic pathways that use L-tryptophan, to thereby produce greater amounts of DMT.

Example 13. PsiD-Independent Psilocybin Biosynthesis Pathway to Produce DMT in *Psilocybe*

A codon optimized Indolethylamine N-methyltransferase from *Homo sapiens* HsINMT (SEQ ID NO: 129) and a codon optimized aromatic L-amino acid decarboxylase (AAAD) from *P. cubensis* (SEQ ID NO: 122) are introduced into *Psilocybe cubensis*. The resulting fungi is crossed with a fungi tryptophan decarboxylase as described above and may be further crossed with a line producing more β-carbolines. AAAD is a noncanonical calcium-activatable aromatic amino acid decarboxylase. AAADs are responsible for alkylamine production in kingdoms of life other than fungi, like L-DOPA decarboxylase which catalyzes the first step in the biosynthesis of monoamine neurotransmitters. AAAD in *P. cubensis* shows substrate permissiveness towards L-phenylalanine, L-tyrosine, and L-tryptophan. In *Psilocybe* mushrooms, L-tryptophan decarboxylation is catalyzed by a neofunctionalized phosphatidylserine decarboxylase-like enzyme (PsiD) rather than by AAAD. Here, however, PcAAAD is used to mediate de novo psilocybin biosynthesis under the control of endogenous calcium signaling and/or elevated environmental calcium concentration. HsINMT (HsINMT, 262 aa) di-methylates tryptamine into DMT.

Example 14. Exploiting Gene Diversity of PsiM to Generate Alkaloids

A phylogenetic analysis of PsiM was performed. In particular, amino acid sequences of PsiM gene products of four species of psilocybin-producing fungi: *Psilocybe cubensis, Psilocybe azurescens, Psilocybe cyanescens*, and *Psilocybe tampanensis* were aligned and compared.

FIG. 23 shows a comparison of PsiM gene products from four different psilocybin-producing fungi. The comparison of the aligned sequences reveals diversity in the gene products of PsiM among the different fungal species.

PsiM catalyzes iterative methyl transfer to the amino group of norbaeocystin to yield psilocybin via a monomethylated intermediate, baeocystin. *Psilocybe azurescence* is amongst the most potent psilocybin-producing mushrooms. PsiM is regulated on transcriptional level and more copies of PsiM lead to its over expression.

Accordingly, to screen for production of higher amounts of alkaloids, one or more copies of the PsiM gene from *P. azurescence* (SEQ ID NO: 121) is integrated into a nucleic acid and introduced into the genome of *Psilocybe cubensis*. The overexpression of the heterologous PsiM gene is screened for production of increased amounts of alkaloids. The overexpression of the heterologous PsiM leads to enhanced production of psilocybin.

Example 15. Protoplast Extraction

Protoplasts were prepared for transfection according to the following protocol. On day 1, small blocks of mycelium were inoculated into a 100 mL liquid potato dextrose broth (PDB) medium. This method was consistent with general purpose growth of fungal cells. On Day 3 or Day 4, the mycelial blocks were blended using low to medium speed in order to homogenize the contents of the sample in a falcon tube. The resulting homogenized mycelia samples in solution were then diluted to 150 mL, grown at 28 degrees Celsius at 150 rpm for 16-18 hours. On Days 4 or 5, the homogenized mycelia samples were transferred to new falcon tubes and underwent spinning at 1800 rpm for 5 minutes. The supernatant was disposed. The homogenized mycelia samples were resuspended in an enzyme solution comprising Yatalase with VinoTase or Yatalase with a Protoplast. The resulting suspension was subsequently incubated at 30 degrees Celsius at shaking conditions of 55 rpm for approximately 10-16 hours. On Days 7 or 8, protoplast were separated from the intact mycelium and cell wall debris by filtering the protoplast suspension through four to six layers of sterile cheese cloth followed by filtering the protoplast suspension through sterile nylon fabric (40 μm cell strainer). The filtrate was centrifuged at 2000 rpm for 10 minutes at 4 degrees Celsius. The supernatant was subsequently collected. The pellets in the remaining solution were shaken, gently. MM buffer (10 mL) were added to each pellet while on ice. Protoplasts were then counted, and density adjusted to $10^7$/mL with cold MMC and kept on ice.

Example 16. Protoplast Transfection for RNP Replacement (MMEJ)

Protoplast transfections were carried out for single complex, double complex for protoplast transfection with Plasmid DNA. All transfections included approximately 0.5-1.0×$10^6$ protoplasts for each transformation. All steps are conducted on ice and in darkness unless otherwise indicated. Control samples were run in parallel comprising no guide RNAs or DNA.

Single Complex

An RNP complex is prepared using a Cas9:guide RNA ratio of 1:3. In a solution, an RNP complex buffer, a Cas9_NLS_GFP, a first guide RNA, a second guide RNA, and water are added together. The mixture is then pre-incubated with thermocycler at 35 degrees Celsius for 3 minutes, and then 23 degrees Celsius for 12 minutes. Without cooling, the DNA template is added and gently mixed. The protoplast suspension is separately prepared and kept on ice until the RNP is ready. The RNP complex and DNA repair template are added into the cold protoplast suspension and mixed gently. The resulting mixture is placed on ice in the dark for approximately 10 minutes. A sterilized and filtered PEG solution is added in a 1:1 ratio to the resulting mixture. The resulting mixture is incubated on ice for approximately 20 minutes. An additional aliquot of a sterilized and filtered PEG solution is added in a 1:1 ratio and subsequently incubated on ice for approximately 20 minutes. The solution is left to warm to room temperature, additional PEG solution at room temperature is added and the mixture is incubated at 30 degrees Celsius for 10 minutes, and then at room temperature for 20 minutes in the dark. The reaction is stopped by adding STC and incubating at 26 degrees Celsius to recover and regenerate back cell walls overnight. The incubated mixture is then aliquoted 50 μl and placed directly onto PDAS+Hygromycin (50-80 mg/L)+Timentin (160 mg/L). After approximately 10 days, the colonies with the hygromycin resistance gene will begin to grow on the hygromycin plates.

Double Complex

The above protocol is used with a Cas9:guide RNAs ratio of 1:3 for every guide used (e.g., for two guides it will be 2:3:3 for Cas9:first guide RNA and second guide RNA).

Protoplast Transfection with Plasmid DNA

A protoplast suspension is kept on ice. Plasmid DNA is added into the cold protoplast and mixed gently for 2 minutes. The mixture is placed on ice in the dark for approximately 10 minutes. A cold sterilized and filtered PEG solution is added and placed on ice in the dark for 30 minutes and then moved to room temperature for 10 minutes. An additional aliquot of a sterilized and filtered PEG solution (left to warm to room temperature for 10 minutes) is added and incubated for 20-30 minutes in the dark. STC buffer is then added at room temperature and the resulting mixture is incubated at 26 degrees Celsius for 1 hour. Different dilutions of the mixture with additional STC buffer are plated and incubated. Undiluted mixture is left to incubate overnight at 26 degrees Celsius. The reaction is then analyzed for GFP and mCherry positive transfected protoplast. An overlay of PDAS+Hygromycin (100 mg/L)+Timentin (160 mg/L) added and incubated at 28 degrees Celsius for 2 weeks.

As one of skill in the art will readily appreciate, this disclosure has been presented for purposes of illustration and description. The disclosure above is not intended to limit the invention to the form or forms disclosed herein. Although the description of the disclosure has included description of one or more embodiments and certain variations and modifications, other variations and modifications are within the scope of the present disclosure, e.g., as may be within the skill and knowledge of those in the art, after understanding the present disclosure.

INCORPORATION BY REFERENCE

All publications, patents, and patent applications mentioned in this specification are herein incorporated by reference to the same extent as if each individual publication, patent, or patent application was specifically and individually indicated to be incorporated by reference. Absent any indication otherwise, publications, patents, and patent applications mentioned in this specification are incorporated herein by reference in their entireties.

SEQUENCE LISTING (742 sequences)

SEQ ID NO: 1 - DNA, 1320 bp, unidentified
  source 1..1320: mol_type = unassigned DNA
atgcaggtgatacccgcgtgcaactcggcagcaataagatcactatgtcctactcccgagtcttttagaaacatgggatggctctctgtcagcgatgcggtctacagcgagttcataggagagttggctacccgcgcttccaatcgaaattactccaacgagttcggcctcatgcaacctatccaggaattcaaggctttcattgaaagcgacccggtggtgcaccaagaatttattgacatgttcgagggcattcaggactctccaaggaattatcaggaactatgtaatatgttcaacgatatctttcgcaaagctcccgtctacggagaccttggccctcccgtttatatgattatggccaaattaatgaacacccgagcgggcttctctgcattcacgagacaaaggttgaaccttcacttcaaaaaacttttcgatacctggggattgttcctgtcttcgaaagattctcgaaatgttcttgtggccgaccagttcgacgacagacattgcggctggttgaacgagcgggccttgtctgctatggttaaacattacaatggacgcgcatttgatgaagtcttcctctgcgataaaaatgccccatactacggcttcaactcttacgacgacttctttaatcgcagatttcgaaaccgagatatcgaccgacctgtagtcggtggagttaacaacaccaccctcatttctgctgcttgcgaatcactttcctacaacgtctcttatgacgtccagtctctcgacactttagttttcaaaggagagacttattcgcttaagcatttgctgaataatgaccctttcaccccacaattcgagcatgggagtattctacaaggattcttgaacgtcaccgcttaccaccgatggcacgcacccgtcaatgggacaatcgtcaaaatcatcaacgttccaggtacctactttgcgcaagccccgagcacgattggcgaccctatcccggataacgattacgacccacctccttaccttaagtctcttgtctacttctctaatattgccgcaaggcaaattatgtttattgaagccgacaacaaggaaattggcctcattttccttgtgttcatcggcatgaccgaaatctcgacatgtgaagccacggtgtccgaaggtcaacacgtcaatcgtggcgatgacttgggaatgttccatttcggtggttcttcgttcgcgcttggtctgaggaaggattgcagggcagagatcgttgaaaagttcaccgaacccggaacagtgatcagaatcaacgaagtcgtcgctgctctaaaggcttag

SEQ ID NO: 2 - DNA, 2155 bp, unidentified
  source 1..2155: mol_type = unassigned DNA
atgatcgctgtactattctccttcgtcattgcaggatgcatatactacatcgtttctcgtagagtgaggcggtcgcgcttgccaccagggccgcctggcattcctattcccttcattgggaacatgtttgatatgcctgaagaatctccatggttaacatttctacaatggggacgggattacagtctgtcttgccgcgttgacttctaatatatgaacagctaatatattgtcagacaccgatattctctacgtggatgctggagggacagaaatggttattcttaacacgttggagaccattaccgatctattagaaaagcgagggtccatttattctggccggtgagctgatgttgagttttttgcaattgaatttgtggtcacacgtttccagacttgagagtacaatggtcaacgaacttatggggtgggagtttgacttagggttcatcacatacggcgacaggtggcgcgaagaaaggcgcatgttcgccaaggagttcagtgagaagggcatcaagcaatttcgccatgctcaagtgaaagctgcccatcagcttgtccaacagcttaccaaaacgccagaccgctgggcacaacatattcgccagtaagtactacttgaggaaaatagcgtacgcttcgctgaccggtccgtacatcaaagtcagatagcggcaatgtcactggatattggttatggaattgatcttgcagaagacgacccttggctggaagcgacccatttggctaatgaaggcctcgccatagcatcagtgccgggcaaattttgggtcgattcgttcccttctcgtgagcatccttcttctatgtaggaagggaaggagtctaacaagtgttagtaaaataccttcctgcttggttcccaggtgctgtcttcaagcgcaaagcgaaggtctggcgagaagccgccgaccatatggttgacatgccttatgaaactatgaggaaattagcagttagtcaaatgcgttctccccgtattttttcaatactctaacttcagctcacagcctcaaggattgactcgtccgtcgtatgcttcagctcgtctgcaagccatggatctcaacggtgaccttgagcatcaagaacacgtaatcaagaacacagccgcagaggttaatgtcggtaagtcaaaagcgtccgtcggcaattcaaaattcaggcgctaaagtgggtcttctcaccaaggtggaggcgatactgtaaggatttctcaatcgttagagtataagtgttctaatgcagtacatactccaccaaccagactgtctctgctatgtctgcgttcatcttggccatggtgaagtaccctgaggtccagcgaaaggttcaagcggagcttgatgctctgaccaataacggccaaattcctgactatgacgaagaagatgactccttgccatacctcaccgcatgtatcaaggagcttttccggtggaatcaaatcgcacccctcgctataccgcacaaattaatgaaggacgacgtgtaccgcgggtatctgattcccaagaacactctagtcttcgcaaacacctggtgaggctgtccattcattcctagtacatccgttgccccactaatagcatcttgataacagggcagtattaaacgatccagaagtctatccagatccctctgtgttccgcccagaaagatatcttggtcctgacgggaagcctgataacactgtacgcgacccacgtaaagcggcatttggctatggacgacgaaattggtaagtgcgctttcagaacccccccttccgttgactagtgccatgcgcgcatacaatatcgctattgatctgatataacttccctgcggcatttattttggcattcctttagtcccggaattcatctagcgcagtcgacggtttggattgcaggggcaaccctcttatcagcgttcaatatcgagcgacctgtcgatcagaatgggaagcccattgacataccggctgattttactacaggattcttcaggtagctaatttccgtctttgtgtgcataatacccctaacgacgcacgtttacctttttgtaaagacacccagtgcctttccagtgcaggtttgttcctcgaacagagcaagtctcacagtcggtatccggaccctga

SEQ ID NO: 3 - DNA, 1089 bp, unidentified
  source 1..1089: mol_type = unassigned DNA
atggcgttcgatctcaagactgaagacggcctcatcacatatctcactaaacatctttctttggacgtcgacacgagcggagtgaagcgccttagcggaggctttgtcaatgtaacctggcgcattaagctcaatgctccttatcaaggtcatacgagcatcatcctgaagcatgctcagccgcacatgtctacggatgaggattttaagataggtgtagaacgttcggtttacgaataccaggctatcaagctcatgatggccaatcgggaggttctgggaggcgtggatggcatagtttctgtgccagaaggcctgaactacgacttagagaataatgcattgatcatgcaagatgtcgggaagatgaagacccttttagattatgtcaccgccaaaccgccacttgcgacggatatagcccgccttgttgggacagaaattggggggttcgttgccagactccataacataggccgcgagaggcgagacgatcctgagttcaaattcttctctggaaatattgtcggaaggacgacttcagaccagctgtatcaaaccatcatacccaacgcagcgaaatatggcgtcgatgaccccttgctgcctactgtggttaaggaccttgtggacgatgtcatgcacagcgaagagacccttgtcatggcggacctgtggagtggaaatattcttctccagttggaggagggaaacccatcgaagctgcagaagatatatatcctggattgggaactttgcaagtacggcccagcgtcgttggacctgggctatttcttgggtgactgctatttgatatcccgctttcaagacgagcaggtcggtacgacgatgcggcaagcctacttgcaaagctatgcgcgtacgagcaagcattcgatcaactacgccaaagtcactgcaggtattgctgctcatattgtgatgtggaccgactttatgcagtgggggagcgaggaagaaaggataaattttgtgaaaaagggggtagctgcctttcacgacgccaggggcaacaacgacaatggggaaattacgtctaccttactgaaggaatcatccactgcgtaa

SEQ ID NO: 4 - DNA, 930 bp, unidentified
  source 1..930: mol_type = unassigned DNA
atgcatatcagaaatccttaccgtacaccaattgactatcaagcactttcagaggccttccctcccctcaagccatttgtgtctgtcaatgcagatggtaccagttctgttgacctcactatcccagaagcccagagggcgttcacggccgctcttcttcatcgtgacttcgggctcaccatgaccataccagaagaccgtctgtgcccaacagtccccaataggttgaactacgttctgtggattgaagatattttcaactacacgaacaaaaccctcggcctgtcggatgaccgtcctattaaaggcgttgatattggtacaggagcctccgcaatttatcctatgcttgcctgtgctcggttcaaggcatggtctatggttggaacagaggtcgagaggaagtgcattgacacggcccgcctcaatgtcgtcgcgaacaatctccaagaccgtctctcgatattagagacatccattgatggtcctattctcgtccccattttcgaggcgactgaagaatacgaatacgagtttactatgtgtaaccctccattctacgacggtgctgccgatatgcagacttcggatgctgccaaaggatttggatttggcgtgggcgctccccattctggaacagtcatcgaaatgtcgactgagggaggtgaatcggctttcgtcgctcagatggtccgtgagagcttgaagcttcgaacacgatgcagatggtacacgagtaacttgggaaagctgaaatccttgaaagaaatagtggggctgctgaaagaacttgagataagcaactatgccattaacgaatacgttcaggggtccacacgtcgttatgccgttgcgtggtctttcactgatattcaactgcctgaggagctttctcgtccctctaaccccgagctcagctctcttttctag

SEQ ID NO: 5 - DNA, 1572 bp, unidentified
  source 1..1572: mol_type = unassigned DNA
atgtctctggagcgctcaacaagtccaaatcctaccgagcgtacatctcttctatctgacactgcgtctaccatttcatccagagatgacgttgaacagtcaagtctgaagcaaaggcgcacgcctataccaactggacaacttggcggtaaggtctcaatgcattcaattattataaacgctgagggtcatttatggccttatattaaccagtttgtgaatgatatcggcgtctctgatgggaatccacgtaatgttgggttctacagtgggttgatcgaaagtgtatttgcttgcggagaagtttgctctatcttcatgctgtcgaggctttcagatagaataggtcgtcgaccggtgctactcccatctgcactgggtattgcagtgtttactgctctgtttggtttatcaagctcgtttaccatgatgttgactcttcgagtttgcgctggtctcttagccggagcgacgcctatagtacactccattgtcagcgaacttactgatgataccaataatgcactcgttgtaccattatatggcctcataactcccatcggatttgccattgggcccctgatcgggggaacccttgaacacgctgcaactaagtatcccaacgtctttggatatgagctttttcgaaagtacccctacttcttaccatcgtttgttccatgctgcatggctatcgtgggcgtcacattcggctacttctttttaaaagaaacgcttcctagtttagtcaagtctaaaaaaagacttgaacgtcaacggtcctcctcttctatatcatcagagaactctactctatacggtgccacagagcatatcagggactcaacagaagaaaccgcggcggacgaggaacccgattccaagccgaagggtattactgagttaattcgggatccttctatacgggctataatggcttctggtacatttttgatgtttctatacacgagttccgatgtgatattctcactctactgctttactgctgttgaggatggaggcgttggattgcctcccgagaagatcggttatgcattctccgttgcaggcctcatagctatgctcatgcagctttgcataacgccatgggtgctccgtacttttgacaaggctaaagtataccacttctgcatgtgctcgttccctctcgtgtttgcactcatgggatgcctgaatcccctcgctcaaactgggtacagtgaaattaacaaaacacttcatccgaccactacgggactgctctatgctgcaatagccatcttgctccttctagcccgtgtctgcgttatggcattccctatcagcatgatgctggttaaacaaacggccgataagcattcgcttgccactgcgaatggcctcgtgcaagtggccatgacccttgcaagagcattctgccctacaatctcaagctcggtgtttgcttattctactagccataatatcctgggtggacatttctgggtggtagtgatggtattcatttccctggttggggtatggcaatctacgaaaattgccagggtcacaaaaacaaaagagcaattgtga

SEQ ID NO: 6 - DNA, 1416 bp, unidentified
  source 1..1416: mol_type = unassigned DNA
atgaatcctacgaccgccaccgatgctcatgaacgaacatcgctgttgtctggaagaccgcaatctgctgcaaattcgacggctccatatgagcgacaagttcaaccatcgcgaaaatcccaatgctttactccagtgaccgtgatcaccataattacgctcatatatcgtctcgcgacaacgatggtaatcacgaccaacattcgggttctccacacagttgcatgccagctttggtatcatgtcaacgatcccgacgtatttccagggggaaatataccagaaaaatattgtgcgctacctggtgtagacaagtattatgctataatggtgtctatgaccactgtcatagatggtcttggaggtatacttgggaccggcatagccagctacatgtcatctcgttttggcagaaagcctgttctcatgttcctgctttcctgtaccatgatcgatcacctcgccatcctgacagtccaaaatgtatacggatggaagcagttggtaacatttgggttaattatgattgttgaaaccattggaaatgagaacaccacagtatttctggtgagcatgtacgtggttgatgttactgaggctgagagaaggaccgctgctctgagttcaattactggctggcttgttctcggaggcgccctcgcctattcaataggcggatctataacaacttttttacactccaactctgccgtatacattgtatcgttcagtgtcactggcatcgttctaacattcaccgcctttgttctccctgaatcattccctgctgaaaaaagagatctcttgcggcttgaacgactggcagaaacccgtggacacagccagtcctggacccaaaaaatcaaagctgtggcaactgtcgcattggaacctatggaattgctaaaaccgacatttaaccccataacggggaaggcaaattggcggcttgtatactgcgccctccactcgtttattgtcactctagcagatgcgtatgctcttcctgccatgttgatatttttcactacccagtattcatatacacccgctcagatgggatatgttatgacgacgtacagtgtctccagtgtgtttgttttggcgatagccttacccctgtttattcgatggttcaagcccctgtataataatactcaaacgaagtctgtcccagatgaaggggatggactccgtgcgaccgactctggagaagcgggtgtgcacacacaagaggtcgttgtttcggaaacctctgatcgcatggacgtccatatcactgtcatatcctggaccatagagtcattagcatacatagttctcggtactgtgggttcattttacgcacaacttttaggtcggccgttgcctctattggctttggatctggacgcattccaggaattcgaagcctag

SEQ ID NO: 7 - DNA, 1077 bp, unidentified
  source 1..1077: mol_type = unassigned DNA
atggcacccgcaacacccgcaactcacgatcctgccttgtcccacggagcccctcctgctccaggtgctccagctcctgcaaatgctcctccaaacgcctcaggagacattgctggaatgcagctcagcggactcgatcagtcccagatcatgaaccttcttcgttcattgcctggcatgttctcgggcggtaaaatacccgaccaaggccaaggcaacaaagaggatgctgctcaaacgctgtccaaccttgcccaagctcaaccgtatggacaacaattaccccttcactaccaagctggcggcccaggaggtctgccaggaattaacgacccaggcccgtccacacatccccgcggccctcccaaccttggccaactgagtgctgtggcaatgcaagccgcccccgctccaattcagcatccagaccagcaaacgaaccgcaacgatggcgagcaggctggcaatgcgagtgcaagtacctccggaaaggatggtgacaatgcagaattcgttcccccacctgctcctgctcctacaactggtcgccgtggtggacgcagcgccaccatgggaagtgacgaatggagcagacagaggaaggataatcataaagaggttgagcgtcgacgccgcggcaatatcaacgagggcatcaacgagcttggccgcattgtacccagtgggtctggcgagaaggccaaaggcgccatcctttctcgagctgtgcagtacatccatcatttgaaagagaacgaagctcgcaatatcgagaagtggacccttgagaagcttctcatggaccaggccatgggtgacctgcaggcgcaactcgaagaggtcaagcgtctgtgggaagaagagcgtatggcgcgcacaagactcgaggccgagctcgaagtgttgagaaatatgaacggcgtgaatgctggctcggccccggcctcgaaagatgagagtgctgcaggtactaagaggaggagtaccgatggagcagaggccgccaccgccgccactgaaagcagcaccgccaatgccgagggcgaacgcgacggcaagcgacaaagaaccgagtga

SEQ ID NO: 8 - DNA, 1320 bp, unidentified
  source 1..1320: mol_type = unassigned DNA
atgcaggtactgcccgcgtgccaatcttccgcgcttaaaacattgtgcccatcccccgaggcctttcgaaagctcggttggctccctactagcgacgaggtttacaacgaattcatcgatgacttgaccggtcgcacgtgcaatgaaaagtactccagccaggttacacttttgaagcctatccaagatttcaagacattcatcgagaatgatcccatagtgtatcaagaatttatctctatgtttgaaggaatcgagcagtctcccaccaactaccacgagctatgtaacatgttcaacgacatctttcgcaaagccccactctacggcgatcttggtcctccggtttacatgatcatggccagaataatgaatacgcaggcgggtttctctgcgttcacaaaagagagcttgaacttccatttcaaaaagctcttcgacacctgggggctattcctttcctcgaaaaactctcgaaacgtgcttgttgcagaccagtttgacgataagcattacgggtggttcagcgagcgagccaagactgccatgatgattaattatccagggcgtacattcgagaaagtcttcatctgcgacgagcacgttccataccatggcttcacttcctatgacgatttcttcaatcgcaggttcagggacaaggatacagatcggcccgtagtcggtggggttactgacaccactttaatcggggctgcctgtgaatcgttgtcatataacgtctctcacaacgtccagtctcttgacacgctagtcatcaagggagaggcctattcacttaaacatctacttcataacgaccccttcacaccgcaattcgaacatgggagcatcattcaaggattcctaaatgtcaccgcttaccaccgctggcactcccccgtcaatggcacgattgtgaagatcgtcaacgttccaggtacctacttcgctcaagctccatatacaattggatctcctatccccgataacgaccgcgacccgcctccttacctcaagtcactcgtatacttctccaacatcgctgcacggcaaattatgttcatcgaggccgacaacaaagacatcggcctcattttcttggtcttcattggaatgactgagatctcgacttgcgaggcgacggtgtgcgaaggtcagcatgtcaaccgcggtgacgatttgggcatgttccatttcggtggttcatcttttgcccttggcttgcggaaggactcgaaggcgaagattttggaaaagttcgcgaaaccggggaccgttattaggatcaacgagctagttgcatctgtaaggaagtag

SEQ ID NO: 9 - DNA, 1521 bp, unidentified
  source 1..1521: mol_type = unassigned DNA
atgattgttctattggtctcgctcgtccttgcaggatgcatatactacgccaacgctcgtagagtaaggcgctcgcgcttaccaccgggcccgcctggcataccactgcccttcattgggaatatgtttgatatgccttcagagtcaccgtggttaagatttcttcaatggggacgggactatcacactgatatcctttacttgaatgctggcggaacggaaataattattctgaacacactggatgctataaccgacttgttggaaaagcgagggtcgatgtattcgggtcgactcgagagcaccatggtgaacgaactcatggggtgggagttcgacttgggattcataacctatggtgaaagatggcgcgaagaaagacgcatgttcgccaaggagttcagcgaaaaaaacatcaggcaattccgccacgcccaaattaaagctgccaatcagcttgttcggcagctgatcaaaacgccagatcgttggtcgcagcacatccggcatcagatagcagccatgtctctagacattggttatggaattgatctcgcagaggatgacccctggattgcagcaacccagctagctaacgaagggctcgccgaagcttcagtaccgggcagtttctgggtcgactcattccccgccctcaaataccttccttcatggcttcctggtgcaggattcaagcgcaaagcaaaggtatggaaggaaggtgctgaccatatggtgaacatgccgtatgaaacgatgaaaaaattgactgttcaaggcttggcccgaccttcatatgcctcagctcgtctgcaggccatggaccccgatggcgatctcgagcatcaggaacacgtgatcagaaacacagcgactgaggtcaatgtcggcggaggtgatacgactgtttctgctgtgtcagcctttattttggccatggtcaaatatccagaagttcaacgccaagtccaagcagaactggatgcactcaccagcaaaggagttgtcccaaactatgacgaagaagacgactccttgccataccttacggcttgcgtcaaggaaatctttcgatggaaccaaatagcaccccttgctatccctcatcggctgatcaaagacgatgtttatcgtgggtatctcataccaaagaatgctttggtctacgccaactcatgggctgtgttgaatgacccagaggagtacccaaatccctctgagttccgaccagaacgatatttgagctctgacggaaagcccgacccaacggtccgtgatccccgcaaagcagcatttggctatggtcgacgcaactgtcccggaatccacctggcacaatcgacggtatggattgctggagccactcttctctcggtattcaatatcgaacgtcctgttgatgggaatggaaaacccatcgacatcccggcgacgttcactaccggattcttcagacatcccgagcctttccagtgcagatttgtccctcgcactcaggagattctaaaatccgtttccggt

SEQ ID NO: 10 - DNA, 1086 bp, unidentified
  source 1..1086: mol_type = unassigned DNA
atgactttcgatctcaagactgaagaaggcctgctctcatacctcacaaagcacctatcgctggacgttgctcccaacggggtgaaacgtcttagtggaggcttcgtcaacgttacctggcgggtcgggctcaatgccccttatcatggtcacacgagcattattctgaagcatgctcaaccgcacctgtcttcagacatagatttcaagataggtgttgaacgatcggcgtacgagtatcaagcgctcaaaatcgtgtcagccaatagctcccttctaggcagcagcgatattcgggtctctgtaccagaaggtcttcactacgacgtcgttaataacgcattgatcatgcaagatgtcgggacaatgaagaccctgttggactatgtcactgccaaaccaccaatttctgcagagatcgccagtctcgtaggcagtcaaattggtgcatttatcgctaggctgcacaacctcggccgcgagaataaagacaaggacgacttcaagttcttctctggaaacatcgtcgggagaacaaccgcagaccagttgtatcaaaccatcatacctaatgccgctaaatacggtatcgacgatccaattctcccaattgtggtaaaggagttggtggaggaggtcatgaatagtgaagaaacgcttatcatggcggatttatggagtggcaatattcttctccagtttgatgaaaactcgacggaattgacgaggatatggctggtagactgggagttgtgcaaatatggtccaccgtctttggacatggggtacttcttaggcgactgtttcctggtcgctcgatttcaagatcagctcgtagggacatcaatgcgacaggcctacttgaagagctacgcaaggaatgtcaaggagccaatcaattatgcaaaagccaccgcaggcatcggcgcgcatctcgtcatgtggactgatttcatgaagtgggggaacgatgaagagagggaagagtttgttaagaaaggcgtggaagccttccatgaagcaaatgaggacaatagaaacggggagattacgtctatacttgtgaaggaagcatcgcgcacttag

SEQ ID NO: 11 - DNA, 930 bp, unidentified
  source 1..930: mol_type = unassigned DNA
atgcatatcaggaacccataccgcgatggtgttgactaccaagcactcgctgaagcatttccggctctcaaaccacatgtcacagtaaattcagacaatacgacctccatcgactttgctgtgccagaagcccaaagactgtatacagctgcccttctacaccgggatttcggtcttacgatcacactcccggaagaccgtctttgtccgacagtgcctaatcggctcaactatgtcctttgggttgaagatatccttaaagtcacttctgatgctctcggtcttccggataatcgtcaagttaaggggatcgatatcggaactggcgcatcagcgatatatcccatgctcgcatgctctcgttttaagacatggtccatggttgcaacagaggtagaccagaagtgtattgacactgctcgtctcaacgtcattgccaacaacctccaagaacgtctcgcaattatagccacctccgtcgatggtcctatacttgtccccctcttgcaggcgaattctgattttgagtacgattttacgatgtgtaatccgcccttctacgatggggcatccgacatgcagacatcggatgctgcgaaggggtttggattcggtgtgaacgctccgcataccggcacggtgctcgagatggccaccgagggaggtgaatcggccttcgtagcccaaatggtccgcgaaagtttgaatcttcaaacacgatgcaggtggttcacgagtaatttggggaaattgaagtccttgtacgaaattgtggggctgctgcgagaacatcagataagtaactacgcaatcaacgaatacgtccaaggagccactcgtcgatatgcgattgcatggtcgttcatcgatgttcgactgcctgatcatttgtcccgtccatctaaccccgacctaagctctcttttctag

SEQ ID NO: 12 - DNA, 1587 bp, unidentified
  source 1..1587: mol_type = unassigned DNA
atgtcgccagagcgctcagcaagtcttgaaccagatgagcattcgtctctgctctccgatacggcctcctacatctcgagagatgacttagaagactcaaaagcgaagcaaatcccgacgcctataccaaagaaacaacttggagttttattttccatcagattcacagaacctataatttacagtcatttgtggccttatatcaaccaattcgttaatgatatcggggtcgccgacgggaaccctcgctatgttggattttacagtggtttgatcgaaagtgtatttgcttgtggagaagtgtgttctatcttcatgttatcgaggctgtcagacagaataggtcgccgaccagtgttgctcccgtctgccctcggcgtagcattatttacagctttgttcggtttatcgacctcgtttactatgatgctcgttctccgggtttgtgctggtcttttggccggggctactcctatagtccattctgttgtgagtgagctcacggacgaaacgaataatgccctcgtagtacccctttacgggttaattacacctattggctttgcgattggacctctgattggtggaactcttgagcacgctgctactaaatatcccaacgtatttggttatgacttccttcgaaaatatccatactttctaccatcctttgttccatgctgcctagctgtcgttggcgtcaccttcggctatttcttcttgcaagagacgcttcccagtatagtacgggccaagaaaagacttgaacgacagaaatctacttcgtctatttcgtcaagaacctccaccctatacggtgctacagatgatcacaatagagatgcatcagaatcaaccgcgttgtctccggaggaagcggaagatgaaattgactctaagcctcaaagcatcaaagctttaatcgtagacccttctatgcgggccatcatgggttctggtacctttctgatgttcctctacacgagttccgatgttctgttctcactctactgctttactgctgtcgaggacggaggcgtcggattacctcccgacgaaatcggttacgcattctctgttgccggcgtgatagctatgcttatgcagctttgcataacaccttgggtcctacgtacattcgataaggcaaaagtatacaagttctgcatgttctcattcccgcttgtatttgccctcatgggatgtcttaatcccctcgctcaaaccgggtataatgaagtctctaagactatccaccctaccacaacgggacttctttacgctgctattgctgtgttgctactgttggcacgggtctgcgtcatggcgttcccgatcagcatgatgttgattaagcagaatgccgataaaaactcactcgccactgcgaacgggcttgtgcaagtgtcgatgaccattgctagagcactctgccccacggtctctagttcgctcttcgcttattccacgagcaacaatattctgggtggtcatctctgggtccttattatggtgaccatatccctcgcaggcgtctggcagtcgatgagcatcgcccgcgttaccaaaagaaaggaagagctataa

SEQ ID NO: 13 - DNA, 1415 bp, unidentified
  source 1..1415: mol_type = unassigned DNA
atgaatcctacgaccgccaccgatgctcatgaacgaacatcgctgttgtctggaagaccgcaatctgctgcaaattcgacggctccatatgagcgacaagttcaaccatcgcgaaaatcccaatgctttactccagtgaccgtgatcaccataattacgctcatatatcgtctcgcgacaacgatggtaatcacgaccaacattcgggttctccacacagttgcatgccagctttggtatcatgtcaacgatcccgacgtatttccagggggaaatataccagaaaaatattgtgcgctacctggtgtagacaagtattatgctataatggtgtctatgaccactgtcatagatggtcttggaggtatacttgggaccggcatagccagctacatgtcatctcgttttggcagaaagcctgttctcatgttcctgctttcctgtaccatgatcgatcacctcgccatcctgacagtccaaaatgtatacggatggaagcagttggtaacatttgggttaattatgattgttgaaaccattggaaatgagaacaccacagtatttctggtgagcatgtacgtggttgatgttactgaggctgagagaaggaccgctgctcgagttcaattactggctggcttgttctcggaggcgccctcgcctattcaataggcggatctataacaacttttttacactccaactctgccgtatacattgtatcgttcagtgtcactggcatcgttctaacattcaccgcctttgttctccctgaatcattccctgctgaaaaaagagatctcttgcggcttgaacgactggcagaaacccgtggacacagccagtcctggacccaaaaaatcaaagctgtggcaactgtcgcattggaacctatggaattgctaaaaccgacatttaaccccataacggggaaggcaaattggcggcttgtatactgcgccctccactcgtttattgtcactctagcagatgcgtatgctcttcctgccatgttgatatttttcactacccagtattcatatacacccgctcagatgggatatgttatgacgacgtacagtgtctccagtgtgtttgttttggcgatagccttacccctgtttattcgatggttcaagcccctgtataataatactcaaacgaagtctgtcccagatgaaggggatggactccgtgcgaccgactctggagaagcgggtgtgcacacacaagaggtcgttgtttcggaaacctctgatcgcatggacgtccatatcactgtcatatcctggaccatagagtcattagcatacatagttctcggtactgtgggttcattttacgcacaacttttaggtcggccgttgcctctattggctttggatctggacgcattccaggaattcgaagcctag

SEQ ID NO: 14 - DNA, 1112 bp, unidentified
  source 1..1112: mol_type = unassigned DNA
atggcacccacaacacccgcaactcacgatccagccttgtcccacggagctcctcctactcagggctcgcaggcaccagcaaatgcggccccaaatcttaccccagccgacatctctggcatgcaactcaacggcctcgatcagtcccagatcatgaaccttctccgttcattgcccggcatgttcacaggtgctaaaataccagatcaaggacaaggcaatcccaaagaggatgctgcccaaacactgtccaacctcgcacaggcttcatcacccttcggcggccaacatttgcccatccactatcaaaccggcgctgctggtggtcttccaggaatcaacgacccaggcccgtcaactcacccccgcggccctcctaacctcggccagctgagtgctgtcgcgatgcaagcggccccagcgacgatccaacaccaggaccagcaacagtctgggcgccaggaagacggcgagcggccggaaatacgagcattgatagcccatctgcgaaagatggcgagaatggcactggggagtttaaccagacgtctacgagcactccttcgggaggccgtcggggtgggcgcagtgccaccatgggcagcgacgaatggagcaggcagaggaaggataatcataaagaggttgagcgtcggcgccgcggaaatatcaacgaagggattaacgagctgggccgcatcgtaccgagcggatcaggcgagaaagccaaaggcgccatcctctcgcgcgccgtgcagtacatccaccatttgaaagagaatgaagctcggaacatcgagaagtggacgcttgagaagctacttatggatcaggcgatgggcgacctgcaggcgcaacttgaggagatcaagcggctgtgggaggaggagcgcatggctcgtacgaggcttgaggctgagctcgaggtgttgaggaatatgaatggtgtgagtactgccggtgcgggttcgggtgcggcgaaggatgaaagcgctgccggcacgaagcggaggagcacggatggtgctgatgctgccggcacaaatgttgaaggtggtaataacgacaacgctgaaggagagagggacggaaaacgtcagagaactgagtga

SEQ ID NO: 15 - DNA, 2134 bp, unidentified
  source 1..2134: mol_type = unassigned DNA
atgcacagtctcggtctgttcgctttaatcagcttgttgccctacctcgtcgtcgcgcaacgtgcatcgacctttgcaggcgcgactacaaccgctgtgttccccccacccaatgctggtattgcagcaaccgacacgaacttccccgatggctctaaagttggattcccaggtccaacgcgcagtacgtctcttgaacttttgctggaggtgtaaagctcaacgatattttgtagccggagacgaagcagcagcaatagagactgcacctgtggctgccaaagtcgacagcttcttccccctgatcaatgggggtgctgaagatagcacaccgatggaccccttcgacgtcttggtgcacctcggaaatttgagccctttccaatccgtcccatcatcggcgtttggtctgcctggagcatctcctctcattcctgagggatgcgacatcgtacaggcccaccttcttcaccgccatggtgcgcgttaccccactgctgacagtggtcccccaggatttgcagccaaggtcaatgccgctgctaattcgggatctgggttctcggcgaaaggcgatctcagtttcttgaacacttggacttacaaactcggtggtgacattttgacaccttttggtcgctcacaactgtacgctcctatcagtttatggcttgaagcgtcgctcatacttttcaccagcttcaacttgggtgttgggttccgtgtcaaatatggtatgaatattgcttcagcattctaatctctcctactaattaaatgttaggccaattgctgaaaggattcaagaatctacccgtcttccgaacaacctccgaaggtaaatcgcgagtctatacctctatcatcaactagactaatgtaaatcttagcgcgtatgcttgactccgcgttcgtaaatctttgacagaaactgtcaaaatttagctgactctcttttcaatagtctccacttcgctacgggtttcttcggtgtacaaaagtaccaagatagttatcaccaacttatcacgattgaacacgggggaaagcagaacaacacccttgccccttacgagtcttgcactaacggactgaatgatgtcgccgcgttcggtgacattcaaagccagaaatgggcccagatctacttggcccctgcagtaaagaggctgaacgcaaacctcaggggactgcaactcaacgtgacggacttgtttgctatgcaacaactctgcgctttcgaggtacatatttccctctcctcatgttcataatattaatgttacgtcaaaagaccgtcgcccttggatattcctctttctgcgacctgttcactgaggaggaatggagaggattcgaatatcaaagcggtaatacaaaatatatttttgcctttgtacctcttgtgacctgactggacctagatcttcaattctggtactctttcggacccggtaaccccgcatccagcgccatgggtatcggctacgtccaggaactcgtttcacgactcaccaagacgcgcatcacgaccttcgacaccacagtcaacgcctcgattgtgacgagcgatattctcttcccactagaccaacctatttacgttgacgcaacccacgacacgattctgacggctagtgagtgttgtatatctgttatgattcacgtgtcctgacaccttgccagttttcgctgccatgaaccttacgactcttgctgccaacggacctctgcccaccgaccacattccaaaaggccaggtaaacttctcttctttagctggacacccgaacaaccacgctgacacggcgacaactaacagacattcttcgccaatcaactcgcacccttcgcagccaacgtcgtcggccaagtcctctcctgcccggcctcctccaagcccacacacatccgctggataatcaacgacggcgtcgtcccgctcacaggcatcaaaggatgcaagcccgacaaaaacggcatgtgcgagatcaacacgttcatcgcgggcatgaagcagcgcatgcaggagatcgacttcaactttgactgtttcgcgaactacaccgtgcctattcctgatgacatcgtcaatgggcagtacccgcagaacttgaagcctaagaagaagtag

SEQ ID NO: 16 - DNA, 2119 bp, unidentified
  source 1..2119: mol_type = unassigned DNA
atgctggggtcttcctttaccttgtctttggttgggcttttgtgcttgatatccgacgttgcggcagggtctcctccgttggcctcctcgttcgctggatcaacgaccagtgcggtgttcccacctcccaacgctactataacagccacagacacattctttccggatgcttcggacattggctttgctggtcctactccaagtaagctatcaagttgtgcatgatattgggtgtttctagtaaccgtcttcttagctggagacgaagccaatgcaatagccactgccccagtgaatgctaaagtggacaatttcttccctctaatcaatcctggggcgcaggatacgaagaaaaataagcctttcgatgttttggtgcacgccggaagtttaagtccctggcaatcagtcgattctttcggactgccagacgcatctccggttataccgcaagggtgtgagcttgttcaggcacaccttcttcaccgtcatggagccagatatccaacatctggtagcggacctgctaatttcgcggctaaagttcacgcagcagccacaggtgctggattttctgcaacgggtgctcttagcttcttgaacacctggacctataaacttggcgcggaattactgaccccatttggtcgttcacaattgtaaaatttctttatttttcaaatttgcataaccaacagttatacgaataggttcaacttgggagttgggttcagagtgaaatatggtccgcgagttatatattgaagtagtacattgtcacctagctaatacaaattctaggagaactactcaaggactttaaagatttgcctgtctttcgcacaacctctgaaggtattttgatgtacgtatttccttctacatgtggctgacgtggtaactgtagctcgaatggtagattcagcgtcggtattattgtttttcaggagtggccttgagttaatgcctttcctttatttttagcgtacattttgctgcaggttttttcggcgttcaaacgtaccaacaagaatatcaccagcttatcaccattgaaaacgatggtcaaaataatacccttgctccctacgaaacctgtactaatagtaataatgctatcggctctttcggaaacgtccagtcggcaaaatgggcagacgtttacacagcacctataataaaaagactcggaaaagacttgaacggtcttcgacttacagcgaccgacgtaacttcaatgcagcagttatgtgcttatgaggtaggcggatgaaccgatgtcaccagcttccatcttacaggttaccgctcagaccgtggctctcgggttttcccagttctgtaatttgtttactgaagatgaatggaaatctttcgaatacttgaatggtgcgtctaacacttggattgttttacgttatgttgaatgtgcgttttagatctctcattttggtactccaatggacctggaaatcccacctccagtgcaatgggcattggatatgtacaagaacttgtttcacgacttacaaaaacacgaattacaacttttaatacgtctgtcaatgcctcgattgtgactgacgaagtgctctttccacttgaccagcccatatttgtggatgcatctcatgataccatcctttctgcaagtaagcaagatcattttaatgccatggtctcagtgtataacaaatagatctagtattcgttgctatgaattttaccagccttgcagcaaatggcccattgccaacagatcatataccgaaggatcaggtgggagatacccccggcttatttgaacatttcttattttattttttagacatactttgtcaaccaaattgcaccctttgcttccaaccttgttggacaggttctttcttgctctgcgtctacaaagccaactcacattcgatggattctgaacgacggcgttttaccccttactggtatcaaaggttgcaaggccaataaggatggaatgtgtgacctggaagcctttatttctggaatgaaggcacgaatcgcggaggtggacttcgcatttgactgctttgcaaactttaccattcctatccctgataatatagtcaatgggcagtttcctaagtag

SEQ ID NO: 17 - DNA, 1074 bp, unidentified
  source 1..1074: mol_type = unassigned DNA
gcacccgcaacacccgcaactcacgatcctgccttgtcccacggagcccctcctgctccaggtgctccagctcctgcaaatgctcctccaaacgcctcaggagacattgctggaatgcagctcagcggactcgatcagtcccagatcatgaaccttcttcgttcattgcctggcatgttctcgggcggtaaaatacccgaccaaggccaaggcaacaaagaggatgctgctcaaacgctgtccaaccttgcccaagctcaaccgtatggacaacaattaccccttcactaccaagctggcggcccaggaggtctgccaggaattaacgacccaggcccgtccacacatccccgcggccctcccaaccttggccaactgagtgctgtggcaatgcaagccgcccccgctccaattcagcatccagaccagcaaacgaaccgcaacgatggcgagcaggctggcaatgcgagtgcaagtacctccggaaaggatggtgacaatgcagaattcgttcccccacctgctcctgctcctacaactggtcgccgtggtggacgcagcgccaccatgggaagtgacgaatggagcagacagaggaaggataatcataaagaggttgagcgtcgacgccgcggcaatatcaacgagggcatcaacgagcttggccgcattgtacccagtgggtctggcgagaaggccaaaggcgccatcctttctcgagctgtgcagtacatccatcatttgaaagagaacgaagctcgcaatatcgagaagtggacccttgagaagcttctcatggaccaggccatgggtgacctgcaggcgcaactcgaagaggtcaagcgtctgtgggaagaagagcgtatggcgcgcacaagactcgaggccgagctcgaagtgttgagaaatatgaacggcgtgaatgctggctcggccccggcctcgaaagatgagagtgctgcaggtactaagaggaggagtaccgatggagcagaggccgccaccgccgccactgaaagcagcaccgccaatgccgagggcgaacgcgacggcaagcgacaaagaaccgagtga

SEQ ID NO: 18 - DNA, 1482 bp, unidentified
  source 1..1482: mol_type = unassigned DNA
gcacctctcaccaccatgatccccatagtactctcgctcctcatagcaggatgcatatactacatcaacgctcgcaggataaagcgttcccgcttaccccctggaccgcctggcatacctatcccattcattgggaatatgtttgatatgccttcagagtctccatggttgatctttttacaatggggacaggaatatcaaaccgacatcatctacgtcgatgctggaggaacggacatgattattctgaactcattggaggctataaccgacttgttggaaaagcgggggtccctgtactccggtcgactcgagagcacgatggtgaacgagctcatgggatgggagttcgattttggattcataccctacggcgagagatggcgcgaagaaaggcgcatgttcgccaaggagttcagcgagaaaaatataaggcaattccgccacgctcaagtgaaggctgccaatcagcttgtccggcagctgacagacaagccagatcgttggtcacaccacatccggcatcagatagcgtctatggctctggatattggctatgggatcgatctggccgaggatgatccctggattgcagcatctgagctagcaaacgaagggctcgctgttgcatcagtgccgggcagtttctgggtcgacacattccctttccttaaataccttccgtcctggcttccaggtgctgaattcaagcgcaatgcaaagatgtggaaggaaggcgctgaccatatggtgaatatgccatatgaaacaatgaaaaaactgtctgctcaaggtttgacccgaccctcatacgcctcggctcgcctccaggctatggatcctaatggcgatctcgagcaccaggaacgtgtgatcaagaatacggccacacaagtcaatgtcggtggcggtgatacgactgtcggtgctgtgtcagcatttattttagctatggtcaaatatcccgaggttcaacgtaaagtccaagctgagctggatgaattcacgagtaaaggccgtatcccagattacgacgaagataacgactccttgccgtatctcagcgcatgctttaaggaactctttcgatggggccagattgcaccccttgctattgctcatcgacttatcaaggatgatgtttaccgcgagtatactatacctaagaatgctttggtcttcgctaataattggtacggacggactgtactgaacgatccctctgagtatccaaatccctctgagttccgtccagaacgatatctcggtcctgacgggaagcccgacgatacggttcgtgatccccgcaaagcagcattcgggtatggtcgtcgcgtttgccctggaatccaccttgctcagtcgacggtatggattgcaggggtggctcttgtgtccgcgttcaacatcgaactgcctgttgataaggatgggaaatgtattgacataccagcggcgtttacaacaggatttttcaggtaa

SEQ ID NO: 19 - DNA, 1488 bp, unidentified
  source 1..1488: mol_type = unassigned DNA
caaaacggcgcactcactgtatttgttgcatttatttctgcagcgtgcatatactatgtgcacgctcgtcgggctcggcgagcctcgctgccaccaggtccgcgcggaatacccctgccatttgtggggaatgtattcgatatgccttcggagtcttcttggctcacgttcctggaatggggaaaacagtatcaatctgatttgatctacttaaactccgggggaatagaaatggtcattctgaacacgttggaaacaatgaccgatctcttggagaagaggggatctatatattcaggacgactagaaagtacaatggtcaatgaactcatgggttggaaattcgattttggattcgtgacctatggcgagcgctggcgagaagaaagacgcatgttttcgagggagttcaacgagaaaaatatcaaacaatttcgtcatgcacaagtcaaggccctcaaagaactcgttcggaaacttgacaaagacccaagtcgatggtaccagcatcttcgacaccaaattgcatctatggccttggatattggctatggaattgatctcgcagaaaacgacccatggattgaagagaccatcctcgcaaacgatgctctagcccttgcatctgtccctgggtgctattgggttgactcgtttcccattcttcaatatgttccatcttggcttccctttgcaggattcaagcgcaaagcaaaggtgtggaagaaaaataccgagtacatggtcaacgttctatacgagaccatgaaaagacagacagtacaagggttaacccgtccatcctatgcttcagcacgtttacaggccatggctccagacattaaccttgaacatcaagaacgggtaattaaaaattcagcctcacaggttattgttggcggtggcgatactaccgtgtctgcattggcagcatttattctagctatggtcaaatatcctaatgtccaacgcaaggtccaggcggagctcgacgcgatcgcgagccaaaacgaaatacccgactttgacgaagaaaatggaacgatgccatacctcaccgcatgtctcaaagaagttttccgctggaaccagatcgcgccccttggtatcgcccaccggcttgacaaggacgattcttaccgtggctacctcatacccaagggaaccttggtttttgccaacatttgggctatcttgaacgatccattgatgtatcctaatcctggcgagtttcaacctgagcgatatctcggacctgacggcaagcacgatccctctgtgcgcgacccacgtaaaattgccttcggctggggtcgacgcgcttgtcccggcatatacttggcacaatccaccgtatggcacacagcaacgaacctcctctctgcattcaacatagagccacctcttaacgaagagggaaagcctatcaaagtcgaggcggctttcaccactggatttttcaggtatagtccccgcagtgatgcatga

SEQ ID NO: 20 - protein, 485 aa, unidentified
MITILLSLLLAGCIYYINARRVRRSHLPPGPPGIPIPFIGNMFDMPSESPWLTFLQWGRDYQTDILYVDAGGSEMIILNSLEAITDLLEKRGSIYSGRLESTMVNELMGWEFDLGFITYGERWREERRMFAKEFSEKNIRQFRHAQVQAANRLVRQLIKTPGRWSQHIRHQIAAMSLDIGYGIDLAEDDPWLEATQLANEGLAIASVPGSFWVDSFPSLKYLPSWLPGAGFKRKARVWKEGADHMVNMPYETMKKLSAQGLARPSYASARLQAMDPNGDLEHQEHVIKNTATEVNVGGGDTTVSAMSAFILAMVKYPEVQRKVQAELDVLTSKGLIPDYDEEDDSLPYLTACVKELFRWNQIAPLAIAHRLIKDDVYRGYTIPKNALVFANTWAVLNDPEEYPDPSEFRPERYLGPDGKPDHTVRDPRKAAFGYGRRTCPGLHLAQSTVWIAGATLLSVFNIERPVDRTGKPIDIPAAFTTGFFR

SEQ ID NO: 21 - protein, 491 aa, unidentified
MAPLTTMITILLSLLLAGCIYYINARRVRRSHLPPGPPGIPIPFIGNMFDMPSESPWLTFLQWGRDYQTDILYVDAGGSEMIILNSLEAITDLLEKRGSIYSGRLESTMVNELMGWEFDLGFITYGERWREERRMFAKEFSEKNIRQFRHAQVQAANRLVRQLIKTPGRWSQHIRHQIAAMSLDIGYGIDLAEDDPWLEATQLANEGLAIASVPGSFWVDSFPSLKYLPSWLPGAGFKRKARVWKEGADHMVNMPYETMKKLSAQGLARPSYASARLQAMDPNGDLEHQEHVIKNTATEVNVGGGDTTVSAMSAFILAMVKYPEVQRKAQAELDMLTSKGLIPDYDEEDDSLPYLTACVKELFRWNQIAPLAIAHRLIKDDVYRGYTIPKNALVFANTWAVLNDPEEYPDPSEFRPERYLGPDGKPDHTVRDPRKAAFGYGRRTCPGLHLAQSTVWIAGATLLSVFNVERPVDRTGKPIDIPAAFTTGFFR

SEQ ID NO: 22 - protein, 494 aa, unidentified
MAPLTTMIPIVLSLLIAGCIYYINARRIKRSRLPPGPPGIPIPFIGNMFDMPSESPWLIFLQWGQEYQTDIIYVDAGGTDMIILNSLEAITDLLEKRGSLYSGRLESTMVNELMGWEFDFGFIPYGERWREERRMFAKEFSEKNIRQFRHAQVKAANQLVRQLTDKPDRWSHHIRHQIASMALDIGYGIDLAEDDPWIAASELANEGLAVASVPGSFWVDTFPFLKYLPSWLPGAEFKRNAKMWKEGADHMVNMPYETMKKLSAQGLTRPSYASARLQAMDPNGDLEHQERVIKNTATQVNVGGGDTTVGAVSAFILAMVKYPEVQRKVQAELDEFTSKGRIPDYDEDNDSLPYLSACFKELFRWGQIAPLAIAHRLIKDDVYREYTIPKNALVFANNWYGRTVLNDPSEYPNPSEFRPERYLGPDGKPDDTVRDPRKAAFGYGRRVCPGIHLAQSTVWIAGVALVSAFNIELPVDKDGKCIDIPAAFTTGFFR

SEQ ID NO: 23 - protein, 497 aa, unidentified
MHTDSIVISLAAGLAVCIHFANSRRLRRASLPPGPPGIPLPFVGNMFDMPSESPWLKYLQWGKEYQSDIIYLNAGGTEIIVLNTLEAITDLLEKRGSIYSGRLESTMVNELMGWDFDLGFITYGERWREERRMFAKEFNEKNIKQFRHAQIKAANQLVQQLAKTPQRWYQHIRHRIAAMSLDIGYGIDLPEDDPWIAATMLANEGLAEASVPGSFWVDSFPLLKYIPSWMPGAGFKRKAKIWREGTDHMVDMPYETMKKLHAEGLARPSYAWARLQAMDPNGDLEHQEHVIRNTSTEVNTVSAVSAFILAMVKYPKVQRKIQEELDSVLNRGEIPDFDEENDPLPYLTACVKEVFRWNQIAPLAIAHRLDKDDVYRGYLIPKGALVFANSWAVLNDPQVYPDPSEFRPERYLDSEGRPDNTVRDPRKAAFGYGRRNCPGIHLAQTTVWIVAATLLQVFNIERPVDANGTPIDIPAAFTTGFFRYDRFTRLCHLSDFS

SEQ ID NO: 24 - protein, 490 aa, unidentified
MQNGALTVFVAFISAACIYYVHARRARRASLPPGPRGIPLPFVGNVFDMPSESSWLTFLEWGKQYQSDLIYLNSGGIEMVILNTLETMTDLLEKRGSIYSGRLESTMVNELMGWKFDFGFVTYGERWREERRMFSREFNEKNIKQFRHAQVKALKELVRKLDKDPSRWYQHLRHQIASMALDIGYGIDLAENDPWIEETILANDALALASVPGCYWVDSFPILQYVPSWLPFAGFKRKAKVWKKNTEYMVNVLYETMKRQTVQGLTRPSYASARLQAMAPDINLEHQERVIKNSASQVITVSALAAFILAMVKYPNVQRKVQAELDAIASQNEIPDFDEENGTMPYLTACLKEVFRWNQIAPLGIAHRLDKDDSYRGYLIPKGTLVFANIWAILNDPLMYPNPGEFQPERYLGPDGKHDPSVRDPRKIAFGWGRRACPGIYLAQSTVWHTATNLLSAFNIEPPLNEEGKPIKVEAAFTTGFFRYSPRSDA

SEQ ID NO: 25 - protein, 485 aa, unidentified
MITIVLSLLIAGCVYYTNARRIKRSSLPPGPPGIPIPFIGNMFDMPSESPWLTFLQWGQEYQTDIIYVDAGGSDMIILNSLEAITNLLEKRGSLYSGRLESTMVNELMGWEFDFGFIPYGERWREERRMFAKEFTEKNIRQFRHAQVKAANQLVRQLTDKPDRWSHHIRHQIASMALDIGYGIDLAEDDPWIAASELANEGLAVASVPGSFWVDTFPFLKYIPSWLPGAEFKRNAKVWKEGADHMVNMPYERMKKLSAQGLTRPSYASARLQAMDPNGDLEHQERVIKNTATQVNVGGGDTTVGAVSAFILAMVKYPEVQRKVQAELDEFTSKGRIPDYDEDNDSLPYLSACFKELFRWGQIAPLAIAHRLIKDDVYREYTIPKNALVFANNWTVLNDPSEYPNPSEFRPERYLGPDGKPDDTVRDPRKAAFGYGRRVCPGIHLAQSTVWIAGVALVSAFNIELPVDKDGKCIDIPAAFTTGFFR

SEQ ID NO: 26 - protein, 361 aa, unidentified
MTFDLKTEEGLLSYLTKHLSLDVAPNGVKRLSGGFVNVTWRVGLNAPYHGHTSIILKHAQPHLSSDIDFKIGVERSAYEYQALKIVSANSSLLGSSDIRVSVPEGLHYDVVNNALIMQDVGTMKTLLDYVTAKPPISAEIASLVGSQIGAFIARLHNLGRENKDKDDFKFFSGNIVGRTTADQLYQTIIPNAAKYGIDDPILPIVVKELVEEVMNSEETLIMADLWSGNILLQFDENSTELTRIWLVDWELCKYGPPSLDMGYFLGDCFLVARFQDQLVGTSMRQAYLKSYARNVKEPINYAKATAGIGAHLVMWTDFMKWGNDEEREEFVKKGVEAFHEANEDNRNGEITSILVKEASRT

SEQ ID NO: 27 - protein, 309 aa, unidentified
MHIRNPYRTPIDYQALSEAFPPLKPFVSVNADGTSSVDLTIPEAQRAFTAALLHRDFGLTMTIPEDRLCPTVPNRLNYVLWIEDIFNYTNKTLGLSDDRPIKGVDIGTGASAIYPMLACARFKAWSMVGTEVERKCIDTARLNVVANNLQDRLSILETSIDGPILVPIFEATEEYEYEFTMCNPPFYDGAADMQTSDAAKGFGFGVGAPHSGTVIEMSTEGGESAFVAQMVRESLKLRTRCRWYTSNLGKLKSLKEIVGLLKELEISNYAINEYVQGSTRRYAVAWSFTDIQLPEELSRPSNPELSSLF

SEQ ID NO: 28 - protein, 358 aa, unidentified
MAPATPATHDPALSHGAPPAPGAPAPANAPPNASGDIAGMQLSGLDQSQIMNLLRSLPGMFSGGKIPDQGQGNKEDAAQTLSNLAQAQPYGQQLPLHYQAGGPGGLPGINDPGPSTHPRGPPNLGQLSAVAMQAAPAPIQHPDQQTNRNDGEQAGNASASTSGKDGDNAEFVPPPAPAPTTGRRGGRSATMGSDEWSRQRKDNHKEVERRRRGNINEGINELGRIVPSGSGEKAKGAILSRAVQYIHHLKENEARNIEKWTLEKLLMDQAMGDLQAQLEEVKRLWEEERMARTRLEAELEVLRNMNGVNAGSAPASKDESAAGTKRRSTDGAEAATAATESSTANAEGERDGKRQRTE

SEQ ID NO: 29 - DNA, 23 bp, synthetic construct
  source 1..23: mol_type = other DNA
attgcggctggttgaacgagcgg

SEQ ID NO: 30 - DNA, 23 bp, synthetic construct
  source 1..23: mol_type = other DNA
tctctgcattcacgagacaaagg

SEQ ID NO: 31 - DNA, 23 bp, synthetic construct
  source 1..23: mol_type = other DNA
agagttgaagccgtagtatgggg

SEQ ID NO: 32 - DNA, 23 bp, synthetic construct
  source 1..23: mol_type = other DNA
tttcattgaaagcgacccggtgg

SEQ ID NO: 33 - DNA, 23 bp, synthetic construct
  source 1..23: mol_type = other DNA
cagttcgacgacagacattgcgg

SEQ ID NO: 34 - DNA, 23 bp, synthetic construct
  source 1..23: mol_type = other DNA
atcgaccgacctgtcgtcggtgg

SEQ ID NO: 35 - DNA, 23 bp, synthetic construct
  source 1..23: mol_type = other DNA
cttatcacgattgaacacggggg

SEQ ID NO: 36 - DNA, 23 bp, synthetic construct
  source 1..23: mol_type = other DNA
ggggaccactgtcagcagtgggg

SEQ ID NO: 37 - DNA, 23 bp, synthetic construct
  source 1..23: mol_type = other DNA
gactcgcgatttaccttcggagg

SEQ ID NO: 38 - DNA, 23 bp, synthetic construct
  source 1..23: mol_type = other DNA
tggggtaacgcgcaccatggcgg

SEQ ID NO: 39 - DNA, 23 bp, synthetic construct
  source 1..23: mol_type = other DNA
gttagtgcaagactcgtaagggg

SEQ ID NO: 40 - DNA, 23 bp, synthetic construct
  source 1..23: mol_type = other DNA
gctttgaatgtcaccgaacgcgg

SEQ ID NO: 41 - DNA, 23 bp, synthetic construct
  source 1..23: mol_type = other DNA
ttggatatctggctccatgacgg

SEQ ID NO: 42 - DNA, 23 bp, synthetic construct
  source 1..23: mol_type = other DNA
catctccggttataccgcaaggg

SEQ ID NO: 43 - DNA, 23 bp, synthetic construct
  source 1..23: mol_type = other DNA
gctgttatagtagcgttgggagg

SEQ ID NO: 44 - DNA, 23 bp, synthetic construct
  source 1..23: mol_type = other DNA
cgtggtaactgtagctcgaatgg

SEQ ID NO: 45 - DNA, 23 bp, synthetic construct
  source 1..23: mol_type = other DNA
cttccctctaatcaatcctgggg

SEQ ID NO: 46 - DNA, 23 bp, synthetic construct
  source 1..23: mol_type = other DNA
catctccggttataccgcaaggg

SEQ ID NO: 47 - DNA, 23 bp, synthetic construct
  source 1..23: mol_type = other DNA
ttgctggtaccatcaaacgaggg

SEQ ID NO: 48 - DNA, 23 bp, synthetic construct
  source 1..23: mol_type = other DNA
gtcgtacgacacatatccgatgg

SEQ ID NO: 49 - DNA, 23 bp, synthetic construct
  source 1..23: mol_type = other DNA
agatgttcttgggattccagagg

SEQ ID NO: 50 - DNA, 23 bp, synthetic construct
  source 1..23: mol_type = other DNA
gtcggaaaagatggctacgaagg

SEQ ID NO: 51 - DNA, 23 bp, synthetic construct
  source 1..23: mol_type = other DNA
gatttgacgaagatgacggtagg

SEQ ID NO: 52 - DNA, 23 bp, synthetic construct
  source 1..23: mol_type = other DNA
aatgagggggtgtccaacgtcgg

SEQ ID NO: 53 - DNA, 23 bp, synthetic construct
  source 1..23: mol_type = other DNA
caaggaatatgcgtccacatcgg

SEQ ID NO: 54 - DNA, 23 bp, synthetic construct
  source 1..23: mol_type = other DNA
aaaaatacaacatgaaggggcgg

SEQ ID NO: 55 - DNA, 23 bp, synthetic construct
  source 1..23: mol_type = other DNA
cagcgataaaagaaaagacacgg

SEQ ID NO: 56 - DNA, 23 bp, synthetic construct
  source 1..23: mol_type = other DNA
attggtaatccaccgatgggagg

SEQ ID NO: 57 - DNA, 23 bp, synthetic construct
  source 1..23: mol_type = other DNA
ctctgacatggaggtcaaggagg

SEQ ID NO: 58 - DNA, 23 bp, synthetic construct
  source 1..23: mol_type = other DNA
ggatcttgaaatgtctccaaggg

SEQ ID NO: 59 - DNA, 23 bp, synthetic construct
  source 1..23: mol_type = other DNA
gtgaacatttcaccaatctgcgg

SEQ ID NO: 60 - DNA, 23 bp, synthetic construct
  source 1..23: mol_type = other DNA
tcgaaggaggagactataggcgg

SEQ ID NO: 61 - DNA, 23 bp, synthetic construct
  source 1..23: mol_type = other DNA
attgctggaatgcagctcagcgg

SEQ ID NO: 62 - DNA, 23 bp, synthetic construct
  source 1..23: mol_type = other DNA
cattccagcaatgtctcctgagg

SEQ ID NO: 63 - DNA, 23 bp, synthetic construct
  source 1..23: mol_type = other DNA
ttgcctggcatgttctcgggcgg

SEQ ID NO: 64 - DNA, 23 bp, synthetic construct
  source 1..23: mol_type = other DNA
attgtcaccatcctttccggagg

SEQ ID NO: 65 - DNA, 23 bp, synthetic construct
  source 1..23: mol_type = other DNA
ccaaggccaaggcaacaaagagg

SEQ ID NO: 66 - DNA, 23 bp, synthetic construct
  source 1..23: mol_type = other DNA
ggcccgtccacacatccccgcgg

SEQ ID NO: 67 - DNA, 939 bp, unidentified
  source 1..939: mol_type = unassigned DNA
atgcatatcagaaacccatatagaacaccaatcgattatcaagcactcgtcgaagcattcccaccactcaaaccatatgtcacagtcaaccaagataacacaacatctatcgatctcacagtcccagaagtccaaagactctatacagcagcactcctccatagagatttcggactcgtcatcgatctcccagaagatagactctgcccaacactcctcacaagaacaccatctctcaactatgtcctctgggtcgaagatatcctcaaagtcacaaacacagcactcggactctctgaagatagaccagtcaaaggaatcgatatcggaacaggagcagcagcaatctatccaatgctcgcatgcgcaagattcaaaacatggtctatgatcggaacagaaatcgatagaaaatgcatcgatacagcaagagtcaacgtcctcacaaacaacctccaagatagactctctatcatcgaaacatctatcgatggaccaatcctcgtcccaatcttcgaagcaacaacagattatgaatatgatttcacaatgtgcaacccaccattctatgatggagcagcagatatgcaaacatctgatgcagcaaaaggattcggattcggagtcaacgcaccacattctggaacagtcatcgaaatgtctacagaaggaggagaatctgcattcgtcgcacaaatggtcagagaatctctcgatcatagaacaagatgcagatggttcacatctaacctcggaaaactcaaatctctccatgaaatcgtcggactcctcagagaacatcaaatctctaactatgcaatcaacgaatatgtccaaggaacaacaagaagatatgcaatcgcatggtctttcacaaacatcagactcccagaagatctcacaagaccatctaacccagaactctcttctctcttctga

SEQ ID NO: 68-72 - skipped (5 entries)

SEQ ID NO: 73 - DNA, 19 bp, synthetic construct
  source 1..19: mol_type = other DNA
cggtctacagcgagttcat

SEQ ID NO: 74 - DNA, 20 bp, synthetic construct
  source 1..20: mol_type = other DNA
ttgcatgaggccgaactcgt

SEQ ID NO: 75 - DNA, 19 bp, synthetic construct
  source 1..19: mol_type = other DNA
tggctctctgtcagcgatg

SEQ ID NO: 76 - DNA, 20 bp, synthetic construct
  source 1..20: mol_type = other DNA
caaattaatgaacacccgag

SEQ ID NO: 77 - DNA, 19 bp, synthetic construct
  source 1..19: mol_type = other DNA
ggttaacatttctacaatg

SEQ ID NO: 78 - DNA, 20 bp, synthetic construct
  source 1..20: mol_type = other DNA
ggcgaatatgttgtgcccag

SEQ ID NO: 79 - DNA, 20 bp, synthetic construct
  source 1..20: mol_type = other DNA
acgttcggtttacgaatacc

SEQ ID NO: 80 - DNA, 20 bp, synthetic construct
  source 1..20: mol_type = other DNA
gctatatccgtcgcaagtgg

SEQ ID NO: 81 - DNA, 20 bp, synthetic construct
  source 1..20: mol_type = other DNA
tggggactgttgggcacaga

SEQ ID NO: 82 - DNA, 20 bp, synthetic construct
  source 1..20: mol_type = other DNA
tgtgcccaacagtccccaat

SEQ ID NO: 83 - DNA, 20 bp, synthetic construct
  source 1..20: mol_type = other DNA
gaagtcacgatgaagaagag

SEQ ID NO: 84 - DNA, 20 bp, synthetic construct
  source 1..20: mol_type = other DNA
tcgtttctcgtagagtgagg

SEQ ID NO: 85 - DNA, 20 bp, synthetic construct
  source 1..20: mol_type = other DNA
ggaatgccaggcggccctgg

SEQ ID NO: 86 - DNA, 20 bp, synthetic construct
  source 1..20: mol_type = other DNA
gcctcccagaacctcccgat

SEQ ID NO: 87 - DNA, 20 bp, synthetic construct
  source 1..20: mol_type = other DNA
gccaatcgggaggttctggg

SEQ ID NO: 88-89 - skipped (2 entries)

SEQ ID NO: 90 - DNA, 1320 bp, unidentified; identical to SEQ ID NO: 1
  source 1..1320: mol_type = unassigned DNA

SEQ ID NO: 91 - DNA, 939 bp, unidentified; identical to SEQ ID NO: 67
  source 1..939: mol_type = unassigned DNA

SEQ ID NO: 92 - DNA, 3039 bp, unidentified
  source 1..3039: mol_type = unassigned DNA
atgccatcttctcatccacatatcacacatagatatagagtcccatcttctgatgatcatgaaagaatctctgcactcttcctcggaccaaaagcagaaaacgcagcattcctccaacaatggctcacaacagtcgtcgcacaacaaaaagcagcaagagatgcatatttcccagatgataacgcattcatcacaacagatatgcaaacatctccagcattcgcacaaacaacaaaagtcatcgcatctaacctcacagaactcctcacagcactcggagaaagatctatcccattcttctctccaagatattctggacatatgtctgtcgatcaatctctcccagcaatcctcggattcctctctacaacattctataacccaaacaacgtcgcattcgaagcatctccattcacaacactcatcgaagaagaagtcggactccaactctctgaaatgctcggatataacagactcaacaacacagaaaaaccactcgcatggggacatatcgcatctggaggaacagtcgcaaacctcgaagcaatgtgggcagcaagaaacctcaaattctatccactctctctcagagatgcatctgcagaaggagcagaaatggaattcatcagagatacattctctgtcaaaacatgcgtcggagataaaaaactcctcaaagattgctctccatgggaactcctcaacctccatgtctctacaatcctcgatatgccagatagactccatgatgaatataacatctctccacaattcctcgaaaaagtcatgagaaaatatatcatccaatctacaaacaaagatacactcatgcaaagatggggactcacacaacaaccagtcgtcctctctccatctacaaaccattattcttggccaaaagcagcagcagtcctcggaatcggatctgataacctcagaaacgtcccagtcgatatccaagcacatatggatatcaacgaactcgatagaatgctcaaaatctgcctcgatgaagaaacaccagtctatcaagtcgtcgcagtcatcggaacaacagaagaaggaggagtcgatagaatcacagaaatcctcaaactcagacaaaaatatgaagcactcggactctctttcgcaatccatgcagatgcagcatggggaggatatttcgcaacaatgctcccaaaagatacactcggaagaaacagaacaagactcccaaaagaagatacaacatctggattcgtcccacatgtcggactcagagaagaatctgcactccaactctctcatatcaaatatgcagattctatcacaatcgatccacataaagcaggatatgtcccatatccagcaggagcactctgctatagagatggaagaatgagatatctcctcacatggtctgcaccatatctcgcacaaggaaacgaaggacaatctatcggaatctatggaatcgaaggatctaaaccaggagcagcagcatctgcagtcttcatggcacatgaaacaatcggactcacaccatctggatatggaaacctcctcggacaagcaatgttcacatgcagaagatatgcagcacattggtctgcaatgtctacagatacaacatctttcacagtcacaccattcaacccaatcccagcagatatcgatccaaacgcagatccagcaaaagtcgaagaacaaaaacaattcatcagagatagaatcctcttcaaatctaacgaagaaatctataacgattctgaagcaatggaactcctccatcaactcggatctgatctcaacatcaacgtcttcgcatgcaacttcagagatagagataacaacctcaacacagatgtcgaagaagcaaactggctcaacaacagaatcttccaaagattctctgtcacatctgcagaagaaaacccactcgaaacaccattcttcctctcttctacaacactcaaacaatctgaatatggagtctgcgcaacagaagtcaaaagaagaatgggactcgtcggagatcaagatgtcatcgtcctcagaaacgtcgtcatgtctccattcacaacaacaaacgatttcgtcggaacactcgcaaacacattccaaaaaatcgtcgaagaagaagtcgaatatgcaagaatcagaaacgatatgaaaccatctatccatacattcctcctccatggatctggagaacaatattatctcgtccatacaccaacaatccatatggcatctggaagaagacaaatcatcctctctgtcaacgtcgaaggacaagtcagacaagcaatccatgcacatgaaagagtcgaagcagtcatcgtccataacacagtcccactcagactcgatgaaatcgtcgatggaggatctttcgatggaatcctcacaatcggaaaaagaaaaacatctttcaaagtcaaaatctctaacatcaaagtcgtcaaaaaaagatctctcatgacagaagatctcgaatctgcatatccatctctcatgccattctatttctatggaacacaaggacatgcacatctcgatcatgtcatcacagtcgtcccaaacatccatctctctgcaggagaaatccaatataaattcgatgatgaagtctcttctgaagatctcgcaaaaggactcatcgtcgtcgcagaaaacgtccatgaagcatctatgcaaccattcccactcatgaaagatttcaaaatcacaaaccaattcttcttctcttctggacaaatcctcagagtcaaagtctatagagatccatatccagcatctacaatggatccaatcccactccatgatatcaaaaaccaaccagtcgtcacacaaggaacaatcacactcgtcggaaacatctatgtcgattctgatgcactcaacgtcgcatctgaaccaacagcagatgaagatgcagcacatgtcccacatgcaagaaacatgtatggagaaatgacagcaggaacaatcaaaggatggcaaaacgcagtcagacatttccataacaaactcgaaacagtcgcaccaacaaaa

SEQ ID NO: 93 - DNA, 927 bp, unidentified
  source 1..927: mol_type = unassigned DNA
atgcatatcagaaacccatatagaacaccaatcgattatcaagcactctctgaagcattcccaccactcaaaccattcgtctctgtcaacgcagatggaacatcttctgtcgatctcacaatcccagaagcacaaagagcattcacagcagcactcctccatagagatttcggactcacaatgacaatcccagaagatagactctgcccaacagtcccaaacagactcaactatgtcctctggatcgaagatatcttcaactatacaaacaaaacactcggactctctgatgatagaccaatcagaggagtcgatatcggaacaggagcatctgcaatctatccaatgctcgcatgcgcaagattcaaagcatggtctatggtcggaacagaagtcgaaagaaaatgcatcgatacagcaagactcaacgtcgtcgcaaacaacctccaagatagactctctatcctcgaaacatctatcgatggaccaatcctcgtcccaatcttcgaagcaacagaagaatatgaatatgaattcacaatgtgcaacccaccattctatgatggagcagcagatatgcaaacatctgatgcagcaaaaggattcggattcggagtcggagcaccacattctggaacagtcatcgaaatgtctacagaaggaggagaatctgcattcgtcgcacaaatggtcagagaatctctcaaactcagaacaagatgcagatggtatacatctaacctcggaaaactcaaatctctcaaagaaatcgtcggactcctcaaagaactcgaaatctctaactatgcaatcaacgaatatgtccaaggatctacaagaagatatgcagtcgcatggtctttcacagatatccaactcccagaagaactctctagaccatctaacccagaactctcttctctcttc

SEQ ID NO: 94 - DNA, 1077 bp, unidentified
  source 1..1077: mol_type = unassigned DNA
atgccaagaatccaagtcctcgatatcagaggatctaaagaatctgtcggatctacaccacatctcagagcagcaatcctcgaaggactcctcaaaccaccaggatctagaacactcccatctgaaacactctatgatgaagtcggactcaaaatgtataacgatggaatgaaagcatgggcagaatggtattatccagtcgaagcagaaagacaaatcctcgaaagatatggaagagatatcgcaaaactcttcacaacatctgcaaaaggaaaagcagtcctcatcgaactcggagcaggatctctcgataaaacatctcaagtcctcctctctgcagcagaaatcacaagaacaacaggaccaatgaacaacatcgcatattatgcactcgatctcgaaagaggagaactcgaaagaacaatcggaagactccaagaagtcatcggagatcaaatcgcaggaaaaatctctacagcaggaatgtggggaacatatgatgatggaatcagagtcatcgaaaaaaacgaactcgaactcgaaccagatatcccagtccatatcctcttcctcggaggaacaatcggaaacttctctaaacaagatggagatgtcgcattcctcaaatctctcccactcgatcataaaagaggagatacactcctcgtcggaatggatagacataaatctgcagatgcaatcgaaagatcttatggattcgcagcagcaaaagattggatcatgaacggactcaaagtctctggaagagtcctcacaggagatgaaggactcttcgaaatcggaaactgggaaagatatgcaaaatataacgaagaactcggaagatatgaagcaggatataaatctcaaaaagaacatgcactcaaaatctctgaaggagtcgatatcacattcctcaaagatgaagtcgtcctcgtcatgttctctaacaaatatacagatgcagaaatggattctgtcgtcgattctgcaggactcgtcaaaaacggatcttggatggatgaaaaagcacaatattgcctcctctctctcagagcaaacaacggaccagtctga

SEQ ID NO: 95 - DNA, 1059 bp, Catharanthus roseus
  source 1..1059: mol_type = genomic DNA
atggcaaacttctctgaatctaaatctatgatggcagtcttcttcatgttcttcctcctcctcctctcttcttcttcttcttcttcttcttcttctccaatcctcaaaaaaatcttcatcgaatctccatcttatgcaccaaacgcattcacattcgattctacagataaaggattctatacatctgtccaagatggaagagtcatcaaatatgaaggaccaaactctggattcacagatttcgcatatgcatctccattctggaacaaagcattctgcgaaaactctacagatccagaaaaaagaccactctgcggaagaacatatgatatctcttatgattataaaaactctcaaatgtatatcgtcgatggacattatcatctctgcgtcgtcggaaaagaaggaggatatgcaacacaactcgcaacatctgtccaaggagtcccattcaaatggctctatgcagtcacagtcgatcaaagaacaggaatcgtctatttcacagatgtctcttctatccatgatgattctccagaaggagtcgaagaaatcatgaacacatctgatagaacaggaagactcatgaaatatgatccatctacaaaagaaacaacactcctcctcaaagaactccatgtcccaggaggagcagaaatctctgcagatggatctttcgtcgtcgtcgcagaattcctctctaacagaatcgtcaaatattggctcgaaggaccaaaaaaaggatctgcagaattcctcgtcacaatcccaaacccaggaaacatcaaaagaaactctgatggacatttctgggtctcttcttctgaagaactcgatggaggacaacatggaagagtcgtctctagaggaatcaaattcgatggattcggaaacatcctccaagtcatcccactcccaccaccatatgaaggagaacatttcgaacaaatccaagaacatgatggactcctctatatcggatctctcttccattcttctgtcggaatcctcgtctatgatgatcatgataacaaaggaaactcttatgtctcttcttga

SEQ ID NO: 96 - DNA, 939 bp, Marinactinospora thermotolerans
  source 1..939: mol_type = genomic DNA
agacaaatcgaaatcgaatgggtccaaccaggaatcacagtcacagcagatctctcttgggaaagaaacccagaactcgcagaactcctctggacaggactcctcccatataactctctccaaaaccatgcactcgtctctggaaaccatctctatcatctcatcgcagatccaagactcgtctatacagaagcaagatataaagaagatagaacaaaatctccagatggaacagtcttcctctctcaactccaacatctcgcagtcaaatatggaccactcacagaatatctcccagcagcaccagtcggatctgtcgtcccagaagatatcgatgcactcagagaagcaggaagagcatgctggaaagcagcatgggaaacaaaacaaccaatcgaagtcagagtcagaagaaaaggagaagcagtcacagatttcgcactcccaagaacaccaccagtcgatcatccaggagtccaaaaactcgtcgaagaaatccaagatgaaacagaaagagtctggatcacaccaccagcagaaatcgtcgatatgcatcaaggaagaatcgcatctagagcaggatcttatgatcaatatttctctacactcgtcttcctcaacggagaagtcagaccactcggatattgcgcactcaacggactcctcaaaatctgcagaacaacagatctcacactcaacgatctcaaaagaatcacaccaacattcatcaaaacaccagcagaattcctcggatatacaggactcgatacactctggagattcacacaacaagtcctcacactcctcccagatgtcgaaacaagagaacaatatttcgcactcgtcaacgcactcgcactctatgcaaacatgctcaacacatggaacctccatttcttcccatggcaacatggaacagattatagatatctcgatgca

SEQ ID NO: 97 - DNA, 1539 bp, unidentified
  source 1..1539: mol_type = unassigned DNA
atggatccattgacattacccgcgctacctactcttgctactgtcgagaacttaatcttcaacgaaaaacgaggcaactgtgtcccggtttacgtggaacttccagccgacttgattacaccatgtatggcctacttgcgcatcgcgaaggattctaagtacagttttcttttggaatcggttattggaggagagaatgtcgccagatacagtttcatcggagctgatcctctgaaggtcatcaaaactggccctggagaggaaattacgggcgatcctatgactgcgctccagagggagctagcacttcatcaatatgttaaaatccctgaagtaccaacctttactggtggcgccatcggatatgtgtcgtacgactgcatccaacatttcgaaccaaagacaaaaaccgagctcaaagatgttcttgggattccagaggctgtcttcatgcttgtcgatactcttctcatttacgatcacatcttccagaccttgaaggttgtgtcacacgtcttcattccgaaatcatttggaacaggaaatcttgcctttacataccaaactgctgtgtcgaaggcgcgcaggttggccaaacttcttttgtcaaccgctactcctgagcctccacaacctcccataaccttggggaatgagggggtgtccaacgtcggaaaagatggctacgaaggatttgttacgtctttgaagaaacatatcgtcgctggagacatcattcaggctgtaccctctcaaagactcagcagaccaacttcactgcatccttttaacgcctaccgtcatcttcgtcaaatcaacccctcgccgtacatgttttacctggattgcggagatcttcaaattgttggtgcaagtcctgaaacactctgtaaagtagagaagaatgtcgtctacaaccatgccattgctggtaccatcaaacgagggaaaactcctgaagaggatgagaagcttggtgccgtccttctcgcgtctgaaaaagatagagctgaacacattatgctcgtcgatttggcaagaaacgatgtcaatcgtgtatgccaaccgaagacggtgaaggttgatcatctaatgaaagtcgagaaattcagtcatgtcatccatctgacgtctcaagtttccggaactttaagagacggcctaacaaggtttgatgctttccgatcgatattccctgccggaactgtttctggtgcccccaagatcaaggccattgaaatcatatcatctcttgagcaggaacgacgaggagtatacgctggtgctgtcggtcggtttgattttgccgaagacgagatggatacttgtatagctatccgaaccatgactttcaaggacggcattgcgtatcttcaagcgggtggaggcatcgtgtttgatagcgtcgaagaggacgaatatatcgaaacaattaacaaactggggggcaatgttcgagctctcgaagaggccgaggaatattggtataaggtacagcaaaaccagggcacgaagaaggcaaaccctcggaatgtatag

SEQ ID NO: 98 - DNA, 1530 bp, unidentified
  source 1..1530: mol_type = unassigned DNA
atggaccctcagaaactccctgcatcgccatcttacgaaaccgtcgagcaattgattgttcatgaaaagaaaggaaactgcgtcccagtctatgttcagctccctgcagacctggttacaccatgtatggcgtatctacggattgccaaggactcaaagtatagctttctccttgagtcagtcatcagtggagagaacgtggcccgttatagtttcatcggtgcagaccctctcaagatcgtaaagacaggccccaacgaagaatacaccggcgatcctatgcttgctttacagaaagaactttctcttcaccagtacgtcaagataccagaggtaccaactttcaccggcggggccattggctatgttgcctatgattgcatccaacacttcgagcccaggacaaaaacagagcttcatgattccttgcgtatccctgaagctgtattcatgctcgtcgatactcttctcatttacgaccatctctttcagaatatcaagatcgtttctcacgtatttagtcccaaaacctctccaactggaaaccttgcattcatctacaaaactgcagttgccaaagctcgccgtttggctaaagttcttctcagcgctacaacgcctgagcctcaccaaccgcccattacaacactcgagaccgaaggtgtttccaatgtcggaaaagctggctacgagaaatttgtgacaaagctaaaggagcatatagttgctggggacattatccaagcagttccttctcagcggatagctcgcaagacagatctacatcctttcaatgcatatcgacaccttcgccaagtcaatccttcgccatatatgttcttcatcgacttcggcgacttccaaatcgtcggtgcgagcccagaaaccatgtgtaaagtcgagaagaacgtagttttcaaccatgctatcgctggaactgtaaaacgaggcagaacacctgaagaggacgagagattgggggccgagctcctagcctcagaaaaggatcgggcagaacacatcatgcttgtcgatcttgcacgaaatgatgtcaatcgcgtctgtcagcccaagaccgtcaaggttgatcatttaatgcaagttcaaaagttcagccatgtcattcatttgacatctcaagtttctggtctcttgagggagggaaaaacgaggtttgatgctttcagatctatcttccccgccgggacagtgtctggcgctccaaaaatcaaagctgttgagattgtttactcgctggaaaaagagagacgcggtgtttacgctggagctgtgggccgctttgactttgcagacgatgagatggatacttgtattgccatccgcaccatggttttcaaagccggcactgcgtacttacaggcaggtggtggtatcgtcttcgacagtgttgaagaagatgagtatatggagaccatcaacaaactcaagggaagcacctacgcacttaagcaagcagaagaacactggcaccaaatccagcagaatcagtcgcaaaacacagtagcgtaa

SEQ ID NO: 99 - DNA, 789 bp, Homo sapiens
  source 1..789: mol_type = genomic DNA
atgaaaggaggattcacaggaggagatgaatatcaaaaacatttcctcccaagagattatctcgcaacatattattctttcgatggatctccatctccagaagcagaaatgctcaaattcaacctcgaatgcctccataaaacattcggaccaggaggactccaaggagatacactcatcgatatcggatctggaccaacaatctatcaagtcctcgcagcattcgattctttccaagatatcacactctctgatttcacagatagaaacagagaagaactcgaaaaatggctcaaaaaagaaccaggagcatatgattggacaccagcagtcaaattcgcatgcgaactcgaaggaaactctggaagatgggaagaaaaagaagaaaaactcagagcagcagtcaaaagagtcctcaaatgcgatgtccatctcggaaacccactcgcaccagcagtcctcccactcgcagattgcgtcctcacactcctcgcaatggaatgcgcatgctgctctctcgatgcatatagagcagcactctgcaacctcgcatctctcctcaaaccaggaggacatctcgtcacaacagtcacactcagactcccatcttatatggtcggaaaaagagaattctcttgcgtcgcactcgaaaaagaagaagtcgaacaagcagtcctcgatgcaggattcgatatcgaacaactcctccattctccacaatcttattctgtcacaaacgcagcaaacaacggagtctgcttcatcgtcgcaagaaaaaaaccaggacca

SEQ ID NO: 100 - protein, 520 aa, Escherichia coli
MQTQKPTLELLTCEGAYRDNPTALFHQLCGDRPATLLLESADIDSKDDLKSLLLVDSALRITALGDTVTIQALSGNGEALLALLDNALPAGVESEQSPNCRVLRFPPVSPLLDEDARLCSLSVFDAFRLLQNLLNVPKEEREAMFFGGLFSYDLVAGFEDLPQLSAENNCPDFCFYLAETLMVIDHQKKSTRIQASLFAPNEEEKQRLTARLNELRQQLTEAAPPLPVVSVPHMRCECNQSDEEFGGVVRLLQKAIRAGEIFQVVPSRRFSLPCPSPLAAYYVLKKSNPSPYMFFMQDNDFTLFGASPESSLKYDATSRQIEIYPIAGTRPRGRRADGSLDRDLDSRIELEMRTDHKELSEHLMLVDLARNDLARICTPGSRYVADLTKVDRYSYVMHLVSRVVGELRHDLDALHAYRACMNMGTLSGAPKVRAMQLIAEAEGRRRGSYGGAVGYFTAHGDLDTCIVIRSALVENGIATVQAGAGVVLDSVPQSEADETRNKARAVLRAIATAHHAQETF

SEQ ID NO: 101 - DNA, 17267 bp, synthetic construct
  source 1..17267: mol_type = other DNA
tgagcgtcgcaaaggcgctcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgccagaaggccgccagagaggccgagcgcggccgtgaggcttggacgctagggcagggcatgaaaaagcccgtagcgggctgctacgggcgtctgacgcggtggaaagggggaggggatgttgtctacatggctctgctgtagtgagtgggttgcgctccggcagcggtcctgatcaatcgtcaccctttctcggtccttcaacgttcctgacaacgagcctccttttcgccaatccatcgacaatcaccgcgagtccctgctcgaacgctgcgtccggaccggcttcgtcgaaggcgtctatcgcggcccgcaacagcggcgagagcggagcctgttcaacggtgccgccgcgctcgccggcatcgctgtcgccggcctgctcctcaagcacggccccaacagtgaagtagctgattgtcatcagcgcattgacggcgtccccggccgaaaaacccgcctcgcagaggaagcgaagctgcgcgtcggccgtttccatctgcggtgcgcccggtcgcgtgccggcatggatgcgcgcgccatcgcggtaggcgagcagcgcctgcctgaagctgcgggcattcccgatcagaaatgagcgccagtcgtcgtcggctctcggcaccgaatgcgtatgattctccgccagcatggcttcggccagtgcgtcgagcagcgcccgcttgttcctgaagtgccagtaaagcgccggctgctgaacccccaaccgttccgccagtttgcgtgtcgtcagaccgtctacgccgacctcgttcaacaggtccagggcggcacggatcactgtattcggctgcaactttgtcatgcttgacactttatcactgataaacataatatgtccaccaacttatcagtgataaagaatccgcgcgttcaatcggaccagcggaggctggtccggaggccagacgtgaaacccaacatacccctgatcgtaattctgagcactgtcgcgctcgacgctgtcggcatcggcctgattatgccggtgctgccgggcctcctgcgcgatctggttcactcgaacgacgtcaccgcccactatggcattctgctggcgctgtatgcgttggtgcaatttgcctgcgcacctgtgctgggcgcgctgtcggatcgtttcgggcggcggccaatcttgctcgtctcgctggccggcgccagatctggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacgggatctctgcggaacaggcggtcgaaggtgccgatatcattacgacagcaacggccgacaagcacaacgccacgatcctgagcgacaatatgatcgggcccggcgtccacatcaacggcgtcggcggcgactgcccaggcaagaccgagatgcaccgcgatatcttgctgcgttcggatattttcgtggagttcccgccacagacccggatgatccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggcctcctgtcaatgctggcggcggctctggtggtggttctggtggcggctctgagggtggtggctctgagggtggcggttctgagggtggcggctctgagggaggcggttccggtggtggctctggttccggtgattttgattatgaaaagatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttccctccctcaatcggttgaatgtcgcccttttgtctttggcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctaatcaaacaagtttgtacaaaaaagctgaacgagaaacgtaaaatgatataaatatcaaatgcatatcagaaatccttaccgtacaccaattgactatcaagcactttcagaggccttccctcccctcaagccatttgtgtctgtcaatgcagatggtaccagttctgttgacctcactatcccagaagcccagagggcgttcacggccgctcttcttcatcgtgacttcgggctcaccatgaccataccagaagaccgtctgtgcccaacagtccccaataggttgaactacgttctgtggattgaagatattttcaactacacgaacaaaaccctcggcctgtcggatgaccgtcctattaaaggcgttgatattggtacaggagcctccgcaatttatcctatgcttgcctgtgctcggttcaaggcatggtctatggttggaacagaggtcgagaggaagtgcattgacacggcccgcctcaatgtcgtcgcgaacaatctccaagaccgtctctcgatattagagacatccattgatggtcctattctcgtccccattttcgaggcgactgaagaatacgaatacgagtttactatgtgtaaccctccattctacgacggtgctgccgatatgcagacttcggatgctgccaaaggatttggatttggcgtgggcgctccccattctggaacagtcatcgaaatgtcgactgagggaggtgaatcggctttcgtcgctcagatggtccgtgagagcttgaagcttcgaacacgatgcagatggtacacgagtaacttgggaaagctgaaatccttgaaagaaatagtggggctgctgaaagaacttgagataagcaactatgccattaacgaatacgttcaggggtccacacgtcgttatgccgttgcgtggtctttcactgatattcaactgcctgaggagctttctcgtccctctaaccccgagctcagctctcttttctagcattttacgtttctcgttcagctttcttgtacaaagtggttcgatctagaggatccatggtgagcaagggcgaggagctgttcaccggggtggtgcccatcctggtcgagctggacggcgacgtgaacggccacaagttcagcgtgtccggcgagggcgagggcgatgccacctacggcaagctgaccctgaagttcatctgcaccaccggcaagctgcccgtgccctggcccaccctcgtgaccaccttcacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactcacggcatggacgagctgtacaagtaaagcggcccgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattagcttcatcaacgcaagacatgcgcacgaccgtctgacaggagaggaatttccgacgagcacagaaaggacttgctcttggacgtaggcctatttctcaggcacatgtatcaagtgttcggacgtgggttttcgatggtgtatcagccgccgccaactgggagatgaggaggctttcttggggggcagtcagcagttcatttcacaagacagaggaacttgtaaggagatgcactgatttatcttggcgcaaaccagcaggacgaattagtgggaatagcccgcgaatatctaagttatgcctgtcggcatgagcagaaacttccaattcgaaacagtttggagaggttgtttttgggcataccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtatttcgattttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcccggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcggggtcgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttgacggatctctaggacgcgtcctagaagctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggaaccaccatcaaacaggattttcgcctgctggggcaaaccagcgtggaccgcttgctgcaactctctcagggccaggcggtgaagggcaatcagctgttgcccgtctcactggtgaaaagaaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatatcaactcccctatccattgctcaccgaatggtacaggtcggggacccgaagttccgactgtcggcctgatgcatccccggctgatcgaccccagatctggggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccacatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgggtgatgctgccaacttactgatttagtgtatgatggtgtttttgaggtgctccagtggcttctgtgtctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacccaattatgatagaatttacaagctataaggttattgtcctgggtttcaagcattagtccatgcaagtttttatgctttgcccattctatagatatattgataagcgcgctgcctatgccttgccccctgaaatccttacatacggcgatatcttctatataaaagatatattatcttatcagtattgtcaatatattcaaggcaatctgcctcctcatcctcttcatcctcttcgtcttggtagctttttaaatatggcgcttcatagagtaattctgtaaaggtccaattctcgttttcatacctcggtataatcttacctatcacctcaaatggttcgctgggtttatcgcacccccgaacacgagcacggcacccgcgaccactatgccaagaatgcccaaggtaaaaattgccggccccgccatgaagtccgtgaatgccccgacggccgaagtgaagggcaggccgccacccaggccgccgccctcactgcccggcacctggtcgctgaatgtcgatgccagcacctgcggcacgtcaatgcttccgggcgtcgcgctcgggctgatcgcccatcccgttactgccccgatcccggcaatggcaaggactgccagcgctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccgg

SEQ ID NO: 102 - DNA, 17420 bp, synthetic construct
  source 1..17420: mol_type = other DNA
tgagcgtcgcaaaggcgctcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgccagaaggccgccagagaggccgagcgcggccgtgaggcttggacgctagggcagggcatgaaaaagcccgtagcgggctgctacgggcgtctgacgcggtggaaagggggaggggatgttgtctacatggctctgctgtagtgagtgggttgcgctccggcagcggtcctgatcaatcgtcaccctttctcggtccttcaacgttcctgacaacgagcctccttttcgccaatccatcgacaatcaccgcgagtccctgctcgaacgctgcgtccggaccggcttcgtcgaaggcgtctatcgcggcccgcaacagcggcgagagcggagcctgttcaacggtgccgccgcgctcgccggcatcgctgtcgccggcctgctcctcaagcacggccccaacagtgaagtagctgattgtcatcagcgcattgacggcgtccccggccgaaaaacccgcctcgcagaggaagcgaagctgcgcgtcggccgtttccatctgcggtgcgcccggtcgcgtgccggcatggatgcgcgcgccatcgcggtaggcgagcagcgcctgcctgaagctgcgggcattcccgatcagaaatgagcgccagtcgtcgtcggctctcggcaccgaatgcgtatgattctccgccagcatggcttcggccagtgcgtcgagcagcgcccgcttgttcctgaagtgccagtaaagcgccggctgctgaacccccaaccgttccgccagtttgcgtgtcgtcagaccgtctacgccgacctcgttcaacaggtccagggcggcacggatcactgtattcggctgcaactttgtcatgcttgacactttatcactgataaacataatatgtccaccaacttatcagtgataaagaatccgcgcgttcaatcggaccagcggaggctggtccggaggccagacgtgaaacccaacatacccctgatcgtaattctgagcactgtcgcgctcgacgctgtcggcatcggcctgattatgccggtgctgccgggcctcctgcgcgatctggttcactcgaacgacgtcaccgcccactatggcattctgctggcgctgtatgcgttggtgcaatttgcctgcgcacctgtgctgggcgcgctgtcggatcgtttcgggcggcggccaatcttgctcgtctcgctggccggcgccagatctggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacgggatctctgcggaacaggcggtcgaaggtgccgatatcattacgacagcaacggccgacaagcacaacgccacgatcctgagcgacaatatgatcgggcccggcgtccacatcaacggcgtcggcggcgactgcccaggcaagaccgagatgcaccgcgatatcttgctgcgttcggatattttcgtggagttcccgccacagacccggatgatccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggcctcctgtcaatgctggcggcggctctggtggtggttctggtggcggctctgagggtggtggctctgagggtggcggttctgagggtggcggctctgagggaggcggttccggtggtggctctggttccggtgattttgattatgaaaagatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttccctccctcaatcggttgaatgtcgcccttttgtctttggcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctaatcaaacaagtttgtacaaaaaagctgaacgagaaacgtaaaatgatataatggcgttcgatctcaagactgaagacggcctcatcacatatctcactaaacatctttctttggacgtcgacacgagcggagtgaagcgccttagcggaggctttgtcaatgtaacctggcgcattaagctcaatgctccttatcaaggtcatacgagcatcatcctgaagcatgctcagccgcacatgtctacggatgaggattttaagataggtgtagaacgttcggtttacgaataccaggctatcaagctcatgatggccaatcgggaggttctgggaggcgtggatggcatagtttctgtgccagaaggcctgaactacgacttagagaataatgcattgatcatgcaagatgtcgggaagatgaagacccttttagattatgtcaccgccaaaccgccacttgcgacggatatagcccgccttgttgggacagaaattggggggttcgttgccagactccataacataggccgcgagaggcgagacgatcctgagttcaaattcttctctggaaatattgtcggaaggacgacttcagaccagctgtatcaaaccatcatacccaacgcagcgaaatatggcgtcgatgaccccttgctgcctactgtggttaaggaccttgtggacgatgtcatgcacagcgaagagacccttgtcatggcggacctgtggagtggaaatattcttctccagttggaggagggaaacccatcgaagctgcagaagatatatatcctggattgggaactttgcaagtacggcccagcgtcgttggacctgggctatttcttgggtgactgctatttgatatcccgctttcaagacgagcaggtcggtacgacgatgcggcaagcctacttgcaaagctatgcgcgtacgagcaagcattcgatcaactacgccaaagtcactgcaggtattgctgctcatattgtgatgtggaccgactttatgcagtgggggagcgaggaagaaaggataaattttgtgaaaaagggggtagctgcctttcacgacgccaggggcaacaacgacaatggggaaattacgtctaccttactgaaggaatcatccactgcgtaaatcattttacgtttctcgttcagctttcttgtacaaagtggttcgatctagaggatccatggtgagcaagggcgaggagctgttcaccggggtggtgcccatcctggtcgagctggacggcgacgtgaacggccacaagttcagcgtgtccggcgagggcgagggcgatgccacctacggcaagctgaccctgaagttcatctgcaccaccggcaagctgcccgtgccctggcccaccctcgtgaccaccttcacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactcacggcatggacgagctgtacaagtaaagcggcccgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattagcttcatcaacgcaagacatgcgcacgaccgtctgacaggagaggaatttccgacgagcacagaaaggacttgctcttggacgtaggcctatttctcaggcacatgtatcaagtgttcggacgtgggttttcgatggtgtatcagccgccgccaactgggagatgaggaggctttcttggggggcagtcagcagttcatttcacaagacagaggaacttgtaaggagatgcactgatttatcttggcgcaaaccagcaggacgaattagtgggaatagcccgcgaatatctaagttatgcctgtcggcatgagcagaaacttccaattcgaaacagtttggagaggttgtttttgggcataccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtatttcgattttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcccggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcggggtcgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttgacggatctctaggacgcgtcctagaagctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggaaccaccatcaaacaggattttcgcctgctggggcaaaccagcgtggaccgcttgctgcaactctctcagggccaggcggtgaagggcaatcagctgttgcccgtctcactggtgaaaagaaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatatcaactcccctatccattgctcaccgaatggtacaggtcggggacccgaagttccgactgtcggcctgatgcatccccggctgatcgaccccagatctggggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccacatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgggtgatgctgccaacttactgatttagtgtatgatggtgtttttgaggtgctccagtggcttctgtgtctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacccaattatgatagaatttacaagctataaggttattgtcctgggtttcaagcattagtccatgcaagtttttatgctttgcccattctatagatatattgataagcgcgctgcctatgccttgccccctgaaatccttacatacggcgatatcttctatataaaagatatattatcttatcagtattgtcaatatattcaaggcaatctgcctcctcatcctcttcatcctcttcgtcttggtagctttttaaatatggcgcttcatagagtaattctgtaaaggtccaattctcgttttcatacctcggtataatcttacctatcacctcaaatggttcgctgggtttatcgcacccccgaacacgagcacggcacccgcgaccactatgccaagaatgcccaaggtaaaaattgccggccccgccatgaagtccgtgaatgccccgacggccgaagtgaagggcaggccgccacccaggccgccgccctcactgcccggcacctggtcgctgaatgtcgatgccagcacctgcggcacgtcaatgcttccgggcgtcgcgctcgggctgatcgcccatcccgttactgccccgatcccggcaatggcaaggactgccagcgctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccgg

SEQ ID NO: 103 - DNA, 18494 bp, synthetic construct
  source 1..18494: mol_type = other DNA
tgagcgtcgcaaaggcgctcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgccagaaggccgccagagaggccgagcgcggccgtgaggcttggacgctagggcagggcatgaaaaagcccgtagcgggctgctacgggcgtctgacgcggtggaaagggggaggggatgttgtctacatggctctgctgtagtgagtgggttgcgctccggcagcggtcctgatcaatcgtcaccctttctcggtccttcaacgttcctgacaacgagcctccttttcgccaatccatcgacaatcaccgcgagtccctgctcgaacgctgcgtccggaccggcttcgtcgaaggcgtctatcgcggcccgcaacagcggcgagagcggagcctgttcaacggtgccgccgcgctcgccggcatcgctgtcgccggcctgctcctcaagcacggccccaacagtgaagtagctgattgtcatcagcgcattgacggcgtccccggccgaaaaacccgcctcgcagaggaagcgaagctgcgcgtcggccgtttccatctgcggtgcgcccggtcgcgtgccggcatggatgcgcgcgccatcgcggtaggcgagcagcgcctgcctgaagctgcgggcattcccgatcagaaatgagcgccagtcgtcgtcggctctcggcaccgaatgcgtatgattctccgccagcatggcttcggccagtgcgtcgagcagcgcccgcttgttcctgaagtgccagtaaagcgccggctgctgaacccccaaccgttccgccagtttgcgtgtcgtcagaccgtctacgccgacctcgttcaacaggtccagggcggcacggatcactgtattcggctgcaactttgtcatgcttgacactttatcactgataaacataatatgtccaccaacttatcagtgataaagaatccgcgcgttcaatcggaccagcggaggctggtccggaggccagacgtgaaacccaacatacccctgatcgtaattctgagcactgtcgcgctcgacgctgtcggcatcggcctgattatgccggtgctgccgggcctcctgcgcgatctggttcactcgaacgacgtcaccgcccactatggcattctgctggcgctgtatgcgttggtgcaatttgcctgcgcacctgtgctgggcgcgctgtcggatcgtttcgggcggcggccaatcttgctcgtctcgctggccggcgccagatctggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacgggatctctgcggaacaggcggtcgaaggtgccgatatcattacgacagcaacggccgacaagcacaacgccacgatcctgagcgacaatatgatcgggcccggcgtccacatcaacggcgtcggcggcgactgcccaggcaagaccgagatgcaccgcgatatcttgctgcgttcggatattttcgtggagttcccgccacagacccggatgatccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggcctcctgtcaatgctggcggcggctctggtggtggttctggtggcggctctgagggtggtggctctgagggtggcggttctgagggtggcggctctgagggaggcggttccggtggtggctctggttccggtgattttgattatgaaaagatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttccctccctcaatcggttgaatgtcgcccttttgtctttggcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctaatcaaacaagtttgtacaaaaaagctgaacgagaaacgtaaaatgatataaatatcatgatcgctgtactattctccttcgtcattgcaggatgcatatactacatcgtttctcgtagagtgaggcggtcgcgcttgccaccagggccgcctggcattcctattcccttcattgggaacatgtttgatatgcctgaagaatctccatggttaacatttctacaatggggacgggattacagtctgtcttgccgcgttgacttctaatatatgaacagctaatatattgtcagacaccgatattctctacgtggatgctggagggacagaaatggttattcttaacacgttggagaccattaccgatctattagaaaagcgagggtccatttattctggccggtgagctgatgttgagttttttgcaattgaatttgtggtcacacgtttccagacttgagagtacaatggtcaacgaacttatggggtgggagtttgacttagggttcatcacatacggcgacaggtggcgcgaagaaaggcgcatgttcgccaaggagttcagtgagaagggcatcaagcaatttcgccatgctcaagtgaaagctgcccatcagcttgtccaacagcttaccaaaacgccagaccgctgggcacaacatattcgccagtaagtactacttgaggaaaatagcgtacgcttcgctgaccggtccgtacatcaaagtcagatagcggcaatgtcactggatattggttatggaattgatcttgcagaagacgacccttggctggaagcgacccatttggctaatgaaggcctcgccatagcatcagtgccgggcaaattttgggtcgattcgttcccttctcgtgagcatccttcttctatgtaggaagggaaggagtctaacaagtgttagtaaaataccttcctgcttggttcccaggtgctgtcttcaagcgcaaagcgaaggtctggcgagaagccgccgaccatatggttgacatgccttatgaaactatgaggaaattagcagttagtcaaatgcgttctccccgtattttttcaatactctaacttcagctcacagcctcaaggattgactcgtccgtcgtatgcttcagctcgtctgcaagccatggatctcaacggtgaccttgagcatcaagaacacgtaatcaagaacacagccgcagaggttaatgtcggtaagtcaaaagcgtccgtcggcaattcaaaattcaggcgctaaagtgggtcttctcaccaaggtggaggcgatactgtaaggatttctcaatcgttagagtataagtgttctaatgcagtacatactccaccaaccagactgtctctgctatgtctgcgttcatcttggccatggtgaagtaccctgaggtccagcgaaaggttcaagcggagcttgatgctctgaccaataacggccaaattcctgactatgacgaagaagatgactccttgccatacctcaccgcatgtatcaaggagcttttccggtggaatcaaatcgcacccctcgctataccgcacaaattaatgaaggacgacgtgtaccgcgggtatctgattcccaagaacactctagtcttcgcaaacacctggtgaggctgtccattcattcctagtacatccgttgccccactaatagcatcttgataacagggcagtattaaacgatccagaagtctatccagatccctctgtgttccgcccagaaagatatcttggtcctgacgggaagcctgataacactgtacgcgacccacgtaaagcggcatttggctatggacgacgaaattggtaagtgcgctttcagaacccccccttccgttgactagtgccatgcgcgcatacaatatcgctattgatctgatataacttccctgcggcatttattttggcattcctttagtcccggaattcatctagcgcagtcgacggtttggattgcaggggcaaccctcttatcagcgttcaatatcgagcgacctgtcgatcagaatgggaagcccattgacataccggctgattttactacaggattcttcaggtagctaatttccgtctttgtgtgcataatacccctaacgacgcacgtttacctttttgtaaagacacccagtgcctttccagtgcaggtttgttcctcgaacagagcaagtctcacagtcggtatccggaccctgaatatcattttacgtttctcgttcagctttcttgtacaaagtggttcgatctagaggatccatggtgagcaagggcgaggagctgttcaccggggtggtgcccatcctggtcgagctggacggcgacgtgaacggccacaagttcagcgtgtccggcgagggcgagggcgatgccacctacggcaagctgaccctgaagttcatctgcaccaccggcaagctgcccgtgccctggcccaccctcgtgaccaccttcacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactcacggcatggacgagctgtacaagtaaagcggcccgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattagcttcatcaacgcaagacatgcgcacgaccgtctgacaggagaggaatttccgacgagcacagaaaggacttgctcttggacgtaggcctatttctcaggcacatgtatcaagtgttcggacgtgggttttcgatggtgtatcagccgccgccaactgggagatgaggaggctttcttggggggcagtcagcagttcatttcacaagacagaggaacttgtaaggagatgcactgatttatcttggcgcaaaccagcaggacgaattagtgggaatagcccgcgaatatctaagttatgcctgtcggcatgagcagaaacttccaattcgaaacagtttggagaggttgtttttgggcataccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtatttcgattttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcccggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcggggtcgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttgacggatctctaggacgcgtcctagaagctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggaaccaccatcaaacaggattttcgcctgctggggcaaaccagcgtggaccgcttgctgcaactctctcagggccaggcggtgaagggcaatcagctgttgcccgtctcactggtgaaaagaaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatatcaactcccctatccattgctcaccgaatggtacaggtcggggacccgaagttccgactgtcggcctgatgcatccccggctgatcgaccccagatctggggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccacatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgggtgatgctgccaacttactgatttagtgtatgatggtgtttttgaggtgctccagtggcttctgtgtctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacccaattatgatagaatttacaagctataaggttattgtcctgggtttcaagcattagtccatgcaagtttttatgctttgcccattctatagatatattgataagcgcgctgcctatgccttgccccctgaaatccttacatacggcgatatcttctatataaaagatatattatcttatcagtattgtcaatatattcaaggcaatctgcctcctcatcctcttcatcctcttcgtcttggtagctttttaaatatggcgcttcatagagtaattctgtaaaggtccaattctcgttttcatacctcggtataatcttacctatcacctcaaatggttcgctgggtttatcgcacccccgaacacgagcacggcacccgcgaccactatgccaagaatgcccaaggtaaaaattgccggccccgccatgaagtccgtgaatgccccgacggccgaagtgaagggcaggccgccacccaggccgccgccctcactgcccggcacctggtcgctgaatgtcgatgccagcacctgcggcacgtcaatgcttccgggcgtcgcgctcgggctgatcgcccatcccgttactgccccgatcccggcaatggcaaggactgccagcgctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccgg

SEQ ID NO: 104 - DNA, 17647 bp, synthetic construct
  source 1..17647: mol_type = other DNA
tgagcgtcgcaaaggcgctcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgccagaaggccgccagagaggccgagcgcggccgtgaggcttggacgctagggcagggcatgaaaaagcccgtagcgggctgctacgggcgtctgacgcggtggaaagggggaggggatgttgtctacatggctctgctgtagtgagtgggttgcgctccggcagcggtcctgatcaatcgtcaccctttctcggtccttcaacgttcctgacaacgagcctccttttcgccaatccatcgacaatcaccgcgagtccctgctcgaacgctgcgtccggaccggcttcgtcgaaggcgtctatcgcggcccgcaacagcggcgagagcggagcctgttcaacggtgccgccgcgctcgccggcatcgctgtcgccggcctgctcctcaagcacggccccaacagtgaagtagctgattgtcatcagcgcattgacggcgtccccggccgaaaaacccgcctcgcagaggaagcgaagctgcgcgtcggccgtttccatctgcggtgcgcccggtcgcgtgccggcatggatgcgcgcgccatcgcggtaggcgagcagcgcctgcctgaagctgcgggcattcccgatcagaaatgagcgccagtcgtcgtcggctctcggcaccgaatgcgtatgattctccgccagcatggcttcggccagtgcgtcgagcagcgcccgcttgttcctgaagtgccagtaaagcgccggctgctgaacccccaaccgttccgccagtttgcgtgtcgtcagaccgtctacgccgacctcgttcaacaggtccagggcggcacggatcactgtattcggctgcaactttgtcatgcttgacactttatcactgataaacataatatgtccaccaacttatcagtgataaagaatccgcgcgttcaatcggaccagcggaggctggtccggaggccagacgtgaaacccaacatacccctgatcgtaattctgagcactgtcgcgctcgacgctgtcggcatcggcctgattatgccggtgctgccgggcctcctgcgcgatctggttcactcgaacgacgtcaccgcccactatggcattctgctggcgctgtatgcgttggtgcaatttgcctgcgcacctgtgctgggcgcgctgtcggatcgtttcgggcggcggccaatcttgctcgtctcgctggccggcgccagatctggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacgggatctctgcggaacaggcggtcgaaggtgccgatatcattacgacagcaacggccgacaagcacaacgccacgatcctgagcgacaatatgatcgggcccggcgtccacatcaacggcgtcggcggcgactgcccaggcaagaccgagatgcaccgcgatatcttgctgcgttcggatattttcgtggagttcccgccacagacccggatgatccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggcctcctgtcaatgctggcggcggctctggtggtggttctggtggcggctctgagggtggtggctctgagggtggcggttctgagggtggcggctctgagggaggcggttccggtggtggctctggttccggtgattttgattatgaaaagatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttccctccctcaatcggttgaatgtcgcccttttgtctttggcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctaatcaaacaagtttgtacaaaaaagctgaacgagaaacgtaaaatgatataaatatgcaggtgatacccgcgtgcaactcggcagcaataagatcactatgtcctactcccgagtcttttagaaacatgggatggctctctgtcagcgatgcggtctacagcgagttcataggagagttggctacccgcgcttccaatcgaaattactccaacgagttcggcctcatgcaacctatccaggaattcaaggctttcattgaaagcgacccggtggtgcaccaagaatttattgacatgttcgagggcattcaggactctccaaggaattatcaggaactatgtaatatgttcaacgatatctttcgcaaagctcccgtctacggagaccttggccctcccgtttatatgattatggccaaattaatgaacacccgagcgggcttctctgcattcacgagacaaaggttgaaccttcacttcaaaaaacttttcgatacctggggattgttcctgtcttcgaaagattctcgaaatgttcttgtggccgaccagttcgacgacagacattgcggctggttgaacgagcgggccttgtctgctatggttaaacattacaatggacgcgcatttgatgaagtcttcctctgcgataaaaatgccccatactacggcttcaactcttacgacgacttctttaatcgcagatttcgaaaccgagatatcgaccgacctgtagtcggtggagttaacaacaccaccctcatttctgctgcttgcgaatcactttcctacaacgtctcttatgacgtccagtctctcgacactttagttttcaaaggagagacttattcgcttaagcatttgctgaataatgaccctttcaccccacaattcgagcatgggagtattctacaaggattcttgaacgtcaccgcttaccaccgatggcacgcacccgtcaatgggacaatcgtcaaaatcatcaacgttccaggtacctactttgcgcaagccccgagcacgattggcgaccctatcccggataacgattacgacccacctccttaccttaagtctcttgtctacttctctaatattgccgcaaggcaaattatgtttattgaagccgacaacaaggaaattggcctcattttccttgtgttcatcggcatgaccgaaatctcgacatgtgaagccacggtgtccgaaggtcaacacgtcaatcgtggcgatgacttgggaatgttccatttcggtggttcttcgttcgcgcttggtctgaggaaggattgcagggcagagatcgttgaaaagttcaccgaacccggaacagtgatcagaatcaacgaagtcgtcgctgctctaaaggcttagtacgtttctcgttcagctttcttgtacaaagtggttcgatctagaggatccatggtgagcaagggcgaggagctgttcaccggggtggtgcccatcctggtcgagctggacggcgacgtgaacggccacaagttcagcgtgtccggcgagggcgagggcgatgccacctacggcaagctgaccctgaagttcatctgcaccaccggcaagctgcccgtgccctggcccaccctcgtgaccaccttcacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactcacggcatggacgagctgtacaagtaaagcggcccgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattagcttcatcaacgcaagacatgcgcacgaccgtctgacaggagaggaatttccgacgagcacagaaaggacttgctcttggacgtaggcctatttctcaggcacatgtatcaagtgttcggacgtgggttttcgatggtgtatcagccgccgccaactgggagatgaggaggctttcttggggggcagtcagcagttcatttcacaagacagaggaacttgtaaggagatgcactgatttatcttggcgcaaaccagcaggacgaattagtgggaatagcccgcgaatatctaagttatgcctgtcggcatgagcagaaacttccaattcgaaacagtttggagaggttgtttttgggcataccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtatttcgattttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcccggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcggggtcgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttgacggatctctaggacgcgtcctagaagctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggaaccaccatcaaacaggattttcgcctgctggggcaaaccagcgtggaccgcttgctgcaactctctcagggccaggcggtgaagggcaatcagctgttgcccgtctcactggtgaaaagaaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatatcaactcccctatccattgctcaccgaatggtacaggtcggggacccgaagttccgactgtcggcctgatgcatccccggctgatcgaccccagatctggggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccacatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgggtgatgctgccaacttactgatttagtgtatgatggtgtttttgaggtgctccagtggcttctgtgtctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacccaattatgatagaatttacaagctataaggttattgtcctgggtttcaagcattagtccatgcaagtttttatgctttgcccattctatagatatattgataagcgcgctgcctatgccttgccccctgaaatccttacatacggcgatatcttctatataaaagatatattatcttatcagtattgtcaatatattcaaggcaatctgcctcctcatcctcttcatcctcttcgtcttggtagctttttaaatatggcgcttcatagagtaattctgtaaaggtccaattctcgttttcatacctcggtataatcttacctatcacctcaaatggttcgctgggtttatcgcacccccgaacacgagcacggcacccgcgaccactatgccaagaatgcccaaggtaaaaattgccggccccgccatgaagtccgtgaatgccccgacggccgaagtgaagggcaggccgccacccaggccgccgccctcactgcccggcacctggtcgctgaatgtcgatgccagcacctgcggcacgtcaatgcttccgggcgtcgcgctcgggctgatcgcccatcccgttactgccccgatcccggcaatggcaaggactgccagcgctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccgg

SEQ ID NO: 105 - DNA, 9462 bp, synthetic construct
  source 1..9462: mol_type = other DNA
agatctctaattccggggatcggaaatccagaagcccgagaggttgccgcctttcgggctttttctttttcaaaaaaaaaaatttataaaacgatctgttgcggccggccgccgggttgtgggcaaaggcgctggcgctcgacggtgggcaaccgcttgcggttgtccacgggcggagccggtgcgcgtagcgcattgtccacaagccaagggcgaccaataattgatatatatattcataattgaaaagctaattgaacatactacttgctgtaactacttgccggagcgaggggtgtttgcaagctgttgatctgaaagggctattagcgttctcacgtgcctttttgattagcgatttcacgtgaccttattagcgatttcacgtactccgattagcgatttcacgtaccctgattagcgatttcacgtggatagtttttggagcgggccggaaagccccgtgaatcaaggctttgcggggcattagcggtttcacgtggataactaccctctatccacaggcttccggggataaaaaagcccgctcgacggcgggctgttggatggggatcgcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcaaggccgcgattaaattccaacatggatgctgatttatatgggtataaatgggctcgcgataatgtcgggcaatcaggtgcgacaatctaccgattgtatgggaagcccgatgcgccagagttgtttctgaaacatggcaaaggtagcgttgccaatgttgttacagatgagatggtcagactaaactggctgacggaatttatgcctcttccgaccatcaagcattttatccgtactcctgatgatgcatggttactcaccactgcgatcccagggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcactagaccaatgttacacatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactcttcttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgagatctcaaacaaacacatacagcgacttagtttacccgccaatatatcctgtcaaggatcgtacccctactccaaaaatgtcaaagatacagtctcagaagaccaaagggctattgagacttttcaacaaagggtaatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacagcccaagctgatccctatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagttcagcgagagcctgacctattgcatctcccgccgtgcacagggtgtcacgttgcaagacctgcctgaaaccgaactgcccgctgttcttcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgcctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagagtagatgccgaccgaacaagagctgatttcgagaacgcctcagccagcaactcgcgcgagcctagcaaggcaaatgcgagagaacggccttacgcttggtggcacagttctcgtccacagttcgctaagctcgctcggctggtcgcgggagaattaattcggtacgctgaaatcaccagtctctctctacaaatctatctctctctattttctccataaataatgtgtgagtagtttcccgataagggaaattagggttcttatagggtttcgctcatgtgttgagcatataagaaacccttagtatgtatttgtatttgtaaaatacttctatcaataaaatttctaattcctaaaaccaaaatccagtactaaaatccagatcgatccttcatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgacttccggctcgtatgttgtgtggaattgtgagcggataacaatttcacacaggaaacagctatgaccatgattacgccaagctcggaattaaccctcactaaagggaacaaaagctggagctctggtcccgcaggggcggcggctgaaacatctgcacaagctactgccacggcgcagagtagtggacgggcgacgccgcaggcgactgcgaacccctctagtgcagcttcgcaacaatctgtcgctgctgcggcagcgacgccatcttctgcgagggcgagtccgatgcctgctatgcacgcccaacagaatcccactcagtcgcaacaagcccagcaagcgaatgcggccatacttcaagctgcgattcaacaacaacaactacagcgacaacagcaacaataccagcgcacgttgacccccattcagccacagaagacgaactctcaaggagggcaggtgcagatgcaggttcagccgcaattggccgcaaatggacaatatacgttcacgacgccgttcaatgctgccgcattgcgagccgcaacgcccttgaccgctagtcagcaagctgctgctcaacggatggctgctgcccaagcaaatgcagctaaaatgagcgcggggacccctgcacagaatgcaggcagtaacattcacgtacagccgtcaccgcaacaagcccaggctcaaatccaggtacagcagcagcagacgcttcaggtcccgcaacagcaacaggcgaggacaccacaaatgcaaacgcagcagctacggacgcctcaaattcaggctcagcaattacggacgccacagatgcaaacgcaacagcttcagcgaacgcctcagatgcagacgcaacaacttcaaccgacgccgcagatgcagcctcagcagctccagtctcaaatggggcagatgcaacgccagccgactcctcagcaacatacgcctcagcaacaacatgctcaacttcagcctgtgcaggctcagcagttagcgatggcccagcagcaacagcaacagcagcaaatgcaggctcaaattcagcagcaacaaccacaacaagcgcatctgactccgcaacagtatcagcagtatcagatgtatagcaattattatcaagctgcggcggcaatgcaacaacacgggggacagagactgactccgcaacaacaacaggcaatttggaacgcgcagttccagcgtgctgctgctgctgctggtatgcaggggcagcatggcggggtacctatgaaccaggtacaacaggctgcgctggccgcacacatagcgaaacagcagcaacaacagcaacagcatcaaggtcaaggtccacggtgaatgggtttagcttcgtagatagtgtattagtattttgtaatggacattgggattgggtgaagacaaacccgagaacgtcatctttgtggagtgtttgttcggatttggtgtgaggccgtgcaagcttagtcagcagttagtggaaaaggtggaggtagaaagagggcaagggaagttttcgtctcctttctgatctggtaccaccatcatcaccccagcaaaactctctactctcttagaccttcactttatccttcacttttattctttttcaactcttttcgtttctcaagttctactcccaaagtcgctcgtttctttcgaatttcacgaaagactgcacaaaaagacgtatctttgctagccctgcaagcatcgaccaccgatatccacagcgattcaagaacgattcgagttcaacaaatcttcaactaatgtaattctctttcttttgggataagttgaaacccgaacgaggaactaatctttcactcggtgtagaagcttatcgataccgtcgacctcgagggggggcccggtacccaccggatccacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgctcgagatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagtaagtcgacctgcaggcatgcgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgaaattgtaaacgttaatgttaacgttacaccacaatatatcctgcca

SEQ ID NO: 106 - DNA, 8067 bp, synthetic construct
  source 1..8067: mol_type = other DNA
agatctctaattccggggatcggaaatccagaagcccgagaggttgccgcctttcgggctttttctttttcaaaaaaaaaaatttataaaacgatctgttgcggccggccgccgggttgtgggcaaaggcgctggcgctcgacggtgggcaaccgcttgcggttgtccacgggcggagccggtgcgcgtagcgcattgtccacaagccaagggcgaccaataattgatatatatattcataattgaaaagctaattgaacatactacttgctgtaactacttgccggagcgaggggtgtttgcaagctgttgatctgaaagggctattagcgttctcacgtgcctttttgattagcgatttcacgtgaccttattagcgatttcacgtactccgattagcgatttcacgtaccctgattagcgatttcacgtggatagtttttggagcgggccggaaagccccgtgaatcaaggctttgcggggcattagcggtttcacgtggataactaccctctatccacaggcttccggggataaaaaagcccgctcgacggcgggctgttggatggggatcgcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcaaggccgcgattaaattccaacatggatgctgatttatatgggtataaatgggctcgcgataatgtcgggcaatcaggtgcgacaatctaccgattgtatgggaagcccgatgcgccagagttgtttctgaaacatggcaaaggtagcgttgccaatgttgttacagatgagatggtcagactaaactggctgacggaatttatgcctcttccgaccatcaagcattttatccgtactcctgatgatgcatggttactcaccactgcgatcccagggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcactagaccaatgttacacatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactcttcttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgagatctcaaacaaacacatacagcgacttagtttacccgccaatatatcctgtcaaggatcgtacccctactccaaaaatgtcaaagatacagtctcagaagaccaaagggctattgagacttttcaacaaagggtaatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacagcccaagctgatccctatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagttcagcgagagcctgacctattgcatctcccgccgtgcacagggtgtcacgttgcaagacctgcctgaaaccgaactgcccgctgttcttcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgcctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagagtagatgccgaccgaacaagagctgatttcgagaacgcctcagccagcaactcgcgcgagcctagcaaggcaaatgcgagagaacggccttacgcttggtggcacagttctcgtccacagttcgctaagctcgctcggctggtcgcgggagaattaattcggtacgctgaaatcaccagtctctctctacaaatctatctctctctattttctccataaataatgtgtgagtagtttcccgataagggaaattagggttcttatagggtttcgctcatgtgttgagcatataagaaacccttagtatgtatttgtatttgtaaaatacttctatcaataaaatttctaattcctaaaaccaaaatccagtactaaaatccagatcgatccttcatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgacttccggctcgtatgttgtgtggaattgtgagcggataacaatttcacacaggaaacagctatgaccatgattacgccaagctcggaattaaccctcactaaagggaacaaaagctggagctcgaggtccgcaagtagattgaaagttcagtacgtttttaacaatagagcattctcgaggcttgcgtcattctgtgtcaggctagcagtttataagcgttgaggatctagagctgctgtttccgcgtctcgaatgttctcggtgtttaggggttagcaatctgatatgataataatttgtgatgacatcgatagtacaaaaaccccaattccggtcacatccacctctccgttttctcccatctacacacaacaagcttatcgccgtaattctctttcttttgggataagttgaaacccgaacgaggaactaatctttcactcggtgtagaagcttatcgataccgtcgacctcgagggggggcccggtacccaccggatccacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgctcgagatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctgggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagtaagtcgacctgcaggcatgcgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgaaattgtaaacgttaatgttaacgttacaccacaatatatcctgcca

SEQ ID NO: 107 - DNA, 10791 bp, synthetic construct
  source 1..10791: mol_type = other DNA
aattcgagctcggtacccggggatcctctagagaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgcaggtgatacccgcgtgcaactcggcagcaataagatcactatgtcctactcccgagtcttttagaaacatgggatggctctctgtcagcgatgcggtctacagcgagttcataggagagttggctacccgcgcttccaatcgaaattactccaacgagttcggcctcatgcaacctatccaggaattcaaggctttcattgaaagcgacccggtggtgcaccaagaatttattgacatgttcgagggcattcaggactctccaaggaattatcaggaactatgtaatatgttcaacgatatctttcgcaaagctcccgtctacggagaccttggccctcccgtttatatgattatggccaaattaatgaacacccgagcgggcttctctgcattcacgagacaaaggttgaaccttcacttcaaaaaacttttcgatacctggggattgttcctgtcttcgaaagattctcgaaatgttcttgtggccgaccagttcgacgacagacattgcggctggttgaacgagcgggccttgtctgctatggttaaacattacaatggacgcgcatttgatgaagtcttcctctgcgataaaaatgccccatactacggcttcaactcttacgacgacttctttaatcgcagatttcgaaaccgagatatcgaccgacctgtagtcggtggagttaacaacaccaccctcatttctgctgcttgcgaatcactttcctacaacgtctcttatgacgtccagtctctcgacactttagttttcaaaggagagacttattcgcttaagcatttgctgaataatgaccctttcaccccacaattcgagcatgggagtattctacaaggattcttgaacgtcaccgcttaccaccgatggcacgcacccgtcaatgggacaatcgtcaaaatcatcaacgttccaggtacctactttgcgcaagccccgagcacgattggcgaccctatcccggataacgattacgacccacctccttaccttaagtctcttgtctacttctctaatattgccgcaaggcaaattatgtttattgaagccgacaacaaggaaattggcctcattttccttgtgttcatcggcatgaccgaaatctcgacatgtgaagccacggtgtccgaaggtcaacacgtcaatcgtggcgatgacttgggaatgttccatttcggtggttcttcgttcgcgcttggtctgaggaaggattgcagggcagagatcgttgaaaagttcaccgaacccggaacagtgatcagaatcaacgaagtcgtcgctgctctaaaggcttagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacg

SEQ ID NO: 108 - DNA, 10554 bp, synthetic construct
  source 1..10554: mol_type = other DNA
aattcgagctcggtacccggggatcctctagagaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccatggtttgtctctcgcttgcataccacccagcagctcactgatgtcgacttgtaggttaaagcacccgcaacacccgcaactcacgatcctgccttgtcccacggagcccctcctgctccaggtgctccagctcctgcaaatgctcctccaaacgcctcaggagacattgctggaatgcagctcagcggactcgatcagtcccagatcatgaaccttcttcgttcattgcctggcatgttctcgggcggtaaaatacccgaccaaggccaaggcaacaaagaggatgctgctcaaacgctgtccaaccttgcccaagctcaaccgtatggacaacaattaccccttcactaccaagctggcggcccaggaggtctgccaggaattaacgacccaggcccgtccacacatccccgcggccctcccaaccttggccaactgagtgctgtggcaatgcaagccgcccccgctccaattcagcatccagaccagcaaacgaaccgcaacgatggcgagcaggctggcaatgcgagtgcaagtacctccggaaaggatggtgacaatgcagaattcgttcccccacctgctcctgctcctacaactggtcgccgtggtggacgcagcgccaccatgggaagtgacgaatggagcagacagaggaaggataatcataaagaggttgagcgtcgacgccgcggcaatatcaacgagggcatcaacgagcttggccgcattgtacccagtgggtctggcgagaaggccaaaggcgccatcctttctcgagctgtgcagtacatccatcatttgaaagagaacgaagctcgcaatatcgagaagtggacccttgagaagcttctcatggaccaggccatgggtgacctgcaggcgcaactcgaagaggtcaagcgtctgtgggaagaagagcgtatggcgcgcacaagactcgaggccgagctcgaagtgttgagaaatatgaacggcgtgaatgctggctcggccccggcctcgaaagatgagagtgctgcaggtactaagaggaggagtaccgatggagcagaggccgccaccgccgccactgaaagcagcaccgccaatgccgagggcgaacgcgacggcaagcgacaaagaaccgagtgaagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacg

SEQ ID NO: 109 - DNA, 10968 bp, synthetic construct
  source 1..10968: mol_type = other DNA
aattcgagctcggtacccggggatcctctagagaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccatggtttgtctctcgcttgcataccacccagcagctcactgatgtcgacttgtaggttaaacaaaacggcgcactcactgtatttgttgcatttatttctgcagcgtgcatatactatgtgcacgctcgtcgggctcggcgagcctcgctgccaccaggtccgcgcggaatacccctgccatttgtggggaatgtattcgatatgccttcggagtcttcttggctcacgttcctggaatggggaaaacagtatcaatctgatttgatctacttaaactccgggggaatagaaatggtcattctgaacacgttggaaacaatgaccgatctcttggagaagaggggatctatatattcaggacgactagaaagtacaatggtcaatgaactcatgggttggaaattcgattttggattcgtgacctatggcgagcgctggcgagaagaaagacgcatgttttcgagggagttcaacgagaaaaatatcaaacaatttcgtcatgcacaagtcaaggccctcaaagaactcgttcggaaacttgacaaagacccaagtcgatggtaccagcatcttcgacaccaaattgcatctatggccttggatattggctatggaattgatctcgcagaaaacgacccatggattgaagagaccatcctcgcaaacgatgctctagcccttgcatctgtccctgggtgctattgggttgactcgtttcccattcttcaatatgttccatcttggcttccctttgcaggattcaagcgcaaagcaaaggtgtggaagaaaaataccgagtacatggtcaacgttctatacgagaccatgaaaagacagacagtacaagggttaacccgtccatcctatgcttcagcacgtttacaggccatggctccagacattaaccttgaacatcaagaacgggtaattaaaaattcagcctcacaggttattgttggcggtggcgatactaccgtgtctgcattggcagcatttattctagctatggtcaaatatcctaatgtccaacgcaaggtccaggcggagctcgacgcgatcgcgagccaaaacgaaatacccgactttgacgaagaaaatggaacgatgccatacctcaccgcatgtctcaaagaagttttccgctggaaccagatcgcgccccttggtatcgcccaccggcttgacaaggacgattcttaccgtggctacctcatacccaagggaaccttggtttttgccaacatttgggctatcttgaacgatccattgatgtatcctaatcctggcgagtttcaacctgagcgatatctcggacctgacggcaagcacgatccctctgtgcgcgacccacgtaaaattgccttcggctggggtcgacgcgcttgtcccggcatatacttggcacaatccaccgtatggcacacagcaacgaacctcctctctgcattcaacatagagccacctcttaacgaagagggaaagcctatcaaagtcgaggcggctttcaccactggatttttcaggtatagtccccgcagtgatgcatgaagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacg

SEQ ID NO: 110 - DNA, 10962 bp, synthetic construct
  source 1..10962: mol_type = other DNA
aattcgagctcggtacccggggatcctctagagaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccatggtttgtctctcgcttgcataccacccagcagctcactgatgtcgacttgtaggttaaagcacctctcaccaccatgatccccatagtactctcgctcctcatagcaggatgcatatactacatcaacgctcgcaggataaagcgttcccgcttaccccctggaccgcctggcatacctatcccattcattgggaatatgtttgatatgccttcagagtctccatggttgatctttttacaatggggacaggaatatcaaaccgacatcatctacgtcgatgctggaggaacggacatgattattctgaactcattggaggctataaccgacttgttggaaaagcgggggtccctgtactccggtcgactcgagagcacgatggtgaacgagctcatgggatgggagttcgattttggattcataccctacggcgagagatggcgcgaagaaaggcgcatgttcgccaaggagttcagcgagaaaaatataaggcaattccgccacgctcaagtgaaggctgccaatcagcttgtccggcagctgacagacaagccagatcgttggtcacaccacatccggcatcagatagcgtctatggctctggatattggctatgggatcgatctggccgaggatgatccctggattgcagcatctgagctagcaaacgaagggctcgctgttgcatcagtgccgggcagtttctgggtcgacacattccctttccttaaataccttccgtcctggcttccaggtgctgaattcaagcgcaatgcaaagatgtggaaggaaggcgctgaccatatggtgaatatgccatatgaaacaatgaaaaaactgtctgctcaaggtttgacccgaccctcatacgcctcggctcgcctccaggctatggatcctaatggcgatctcgagcaccaggaacgtgtgatcaagaatacggccacacaagtcaatgtcggtggcggtgatacgactgtcggtgctgtgtcagcatttattttagctatggtcaaatatcccgaggttcaacgtaaagtccaagctgagctggatgaattcacgagtaaaggccgtatcccagattacgacgaagataacgactccttgccgtatctcagcgcatgctttaaggaactctttcgatggggccagattgcaccccttgctattgctcatcgacttatcaaggatgatgtttaccgcgagtatactatacctaagaatgctttggtcttcgctaataattggtacggacggactgtactgaacgatccctctgagtatccaaatccctctgagttccgtccagaacgatatctcggtcctgacgggaagcccgacgatacggttcgtgatccccgcaaagcagcattcgggtatggtcgtcgcgtttgccctggaatccaccttgctcagtcgacggtatggattgcaggggtggctcttgtgtccgcgttcaacatcgaactgcctgttgataaggatgggaaatgtattgacataccagcggcgtttacaacaggatttttcaggtaaagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacg

SEQ ID NO: 111-150 - skipped (40 entries)

SEQ ID NO: 151 - DNA, 2333 bp, unidentified
  source 1..2333: mol_type = unassigned DNA
atgaattttcttctaagcatcgctacccttggactgggacttcaagcctatgctgtcatgataggtccctccgcgactttggttatcggaaacaaaaacatagctcccgacggaattaagcgctcgtaagttgaccttttattttgttactcattctgttccaaacaatcgcagggctgttttagctggaacttcactggacactctatctttccccggacctgtaattcgggccacaaaggtacgtgaattaatggctattgcaatttcatgagtgggaaaccgagtgtgcaatttctcagggcgacacgctgagcttgaacgtcgtcaatcagttaactgatgccactatgctgatgggcacgagcatcgtgagtacctttgtctagccctcattatatttcttgaaggtttcttcagcattggcatggttttcatcaaaaaggaactagttgggcagacggtgttgtcggcgtgactcagtgccctattgctcctggtcattctttcctatatcagtttcccacggccaaccaagctgggactttttggtatcattctcattactgtgcgtatagagtctaggatataaatcaaggcggagatattgatatatttactatacagctacacagtattgcgatggccttagaggagctttgattgtttatgatccaaccgatccctatagaacctggtgcgtgttttaatggtagcgctaaaaattagtttaaattcatcctaatttatttatatacgtaggtatgatatcgacgacggtaagtctcccctgtttcgtcccttgttaagaagctgatagcgacgattcttgtcctatcatgtgtcacagaaagtacaatcattacccttgcagattggtgggttccaatatgacgtgtattgctcagccgtaatctgacttccttttcgaaacaaaggtatcataaggctgctcctctacagaccctccgaactgctaaggaagattcagttctgatcaacgggcaaggtcgcgttcccggagataaaactactgattcaactcccttgtcagtcataaacataattccccaaaagcgatatcggttccgtctcatttcaatttcgtgtgatcctgcattttctttctcgattgatggtcattctatggtaagtccgcttatcaaatttgttaatctaattttcatatgacatactacatgatagaccgtcatcgaagctgactctcagagcgtgcaacctcttactgtgaatgaaattactatcttcgccggtcaacgatattcttttattctttatgccaataatccggtcggaaactactggattcggtcgcagcctacatacccagatgatgggatacaaggctatgcaggaggcatcaactctgccatactacgttactctggagcccccgcagtcaatccaacgacaaaaaaggcttccattactattcctttggttgaagcagatctacggcctctctatagcccggccgccccgggccttccatctccaggagctgccgacgtcaacatcaagctcgatatttcttacaactcaccttccgagacgtttttcgttaataattccaccttcccagaagtcccggttccagtgttgctccagatactcagcggagcccagtcagcaaatgatttgctccccgccggatcggtttatactctcccccctaataaagtcatagaaatatctatgcccggtggaaggcccggaagcccagtaagcttctcagttacacaaatcgttttcaaccactcttatcttgccgcctatagcaccctatgcatttgcatggcgtatgtgattgatcttcatgtagttgacgttacctgacgactctttttagcacgatttctccgtcgtgcgaagcgccggcagcaatcggtacaactatgccaatcctgtcaggcgcgacgtagtgaacataggaatggaagatacggacaacgttaccatacgtttcaagaccgacaattccggcccttggatcctgcactggtgtgtctgcctattccactatagccacatattcatgccctgattacgcacacatcagccacattgattggcatattgaggcgtaagtctcaatcagtgaaaagcatttaatgatgagattgaataccttttctccagtggtttggcggtggttttcacagaggacattccatccattcaattcagcaatcctcctcgtacgcctccatgtactattttcattgatacccttgactcagatcatttatctagctgcttgggatcaactttgtcccattttcaacgccatacctcctcaaaagttccattaa

SEQ ID NO: 152-160 - skipped (9 entries)

SEQ ID NO: 161 - protein, 528 aa, unidentified
MNFLLSIATLGLGLQAYAVMIGPSATLVIGNKNIAPDGIKRSAVLAGTSLDTLSFPGPVIRATKGDTLSLNVVNQLTDATMLMGTSIHWHGFHQKGTSWADGVVGVTQCPIAPGHSFLYQFPTANQAGTFWYHSHYSTQYCDGLRGALIVYDPTDPYRTWYDIDDESTIITLADWYHKAAPLQTLRTAKEDSVLINGQGRVPGDKTTDSTPLSVINIIPQKRYRFRLISISCDPAFSFSIDGHSMTVIEADSQSVQPLTVNEITIFAGQRYSFILYANNPVGNYWIRSQPTYPDDGIQGYAGGINSAILRYSGAPAVNPTTKKASITIPLVEADLRPLYSPAAPGLPSPGAADVNIKLDISYNSPSETFFVNNSTFPEVPVPVLLQILSGAQSANDLLPAGSVYTLPPNKVIEISMPGGRPGSPHPMHLHGHDFSVVRSAGSNRYNYANPVRRDVVNIGMEDTDNVTIRFKTDNSGPWILHCHIDWHIEAGLAVVFTEDIPSIQFSNPPPAWDQLCPIFNAIPPQKFH

SEQ ID NO: 162-164 - skipped (3 entries)

SEQ ID NO: 165 - DNA, 264 bp, synthetic construct
  source 1..264: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgcc

SEQ ID NO: 166-189 - skipped (24 entries)

SEQ ID NO: 190 - DNA, 789 bp, synthetic construct; identical to SEQ ID NO: 99
  source 1..789: mol_type = other DNA

SEQ ID NO: 191 - DNA, 792 bp, synthetic construct
  source 1..792: mol_type = other DNA
atgaagggcggcttcaccggcggcgacgagtaccagaagcacttcctcccccgcgactacctcgccacctactactcgttcgacggctcgccctcgcccgaggccgagatgctcaagttcaacctcgagtgcctccacaagaccttcggccccggcggcctccagggcgacaccctcatcgacatcggctcgggccccaccatctaccaggtcctcgccgccttcgactcgttccaggacatcaccctctcggacttcaccgaccgcaaccgcgaggagctcgagaagtggctcaagaaggagcccggcgcctacgactggacccccgccgtcaagttcgcctgcgagctcgagggcaactcgggccgctgggaggagaaggaggagaagctccgcgccgccgtcaagcgcgtcctcaagtgcgacgtccacctcggcaaccccctcgcccccgccgtcctccccctcgccgactgcgtcctcaccctcctcgccatggagtgcgcctgctgctcgctcgacgcctaccgcgccgccctctgcaacctcgcctcgctcctcaagcccggcggccacctcgtcaccaccgtcaccctccgcctcccctcgtacatggtcggcaagcgcgagttctcgtgcgtcgccctcgagaaggaggaggtcgagcaggccgtcctcgacgccggcttcgacatcgagcagctcctccactcgccccagtcgtactcggtcaccaacgccgccaacaacggcgtctgcttcatcgtcgcccgcaagaagcccggcccctag

SEQ ID NO: 192 - DNA, 789 bp, synthetic construct
  source 1..789: mol_type = other DNA
atgagtgaatgcacaaacttcacagaaggagaattctatcaggcacattttgacccgcgtgcttatgtcaggaatttctactccagccctcgaggacactccgacgaaaaggatttccttacttttgttttaggggtcttcagtagattattttcaactgggaaacacagagggcaaaggttgatagacgtggggagcggaccatcaatccactgcgtcattagcgcctgcgcacactatgacgagattcttctgtctgatttctctgacaacaatcgtagagaaattgaaaaatggctaaaaaaccaagaagggtgtctagattggagtcccatcctccagcacgttagtaaaacggaggggaaaagaccgtccgatttagaggctacgctgaagcaaagaatcaaaaaggttttaaaatgtgacgtccgcctggagaatccgtttgatccgctgacactggaaccagctgactgtgtcattacatctctgtgcttggaagcagcctgtaaagacatgcagatataccgccaggctttacatgggttgaccaagctcctgtgtcccggtggactattcgtcatggtgggtgttctgagtgaaaccttctacaaggtggatgaacagctcttttcttgtcttagcctcaaacagaatgatatcgaggaagcactgaaaggttttggcttctctatccaagagtttaatgtactacctgctgaagaccaaaacaattctgtgtctgactttgaggccgtttttgttcttgtggcgaccaagaacatctga

SEQ ID NO: 193 - DNA, 214 bp, synthetic construct
  source 1..214: mol_type = other DNA
agtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatc

SEQ ID NO: 194-199 - skipped (6 entries)

SEQ ID NO: 200 - DNA, 72 bp, synthetic construct
  source 1..72: mol_type = other DNA
gattataaagatcatgatggagattataaagatcatgatatcgattataaagatgatgatgataaagcagca

SEQ ID NO: 201 - DNA, 45 bp, synthetic construct
  source 1..45: mol_type = other DNA
ccaaaaaaaaaaagaaaagtcggaatccatggagtcccagcagca

SEQ ID NO: 202 - DNA, 48 bp, synthetic construct
  source 1..48: mol_type = other DNA
ggaatccatggagtcccagcagcaccaaaaaaaaaaagaaaagtctga

SEQ ID NO: 203 - DNA, 4101 bp, synthetic construct
  source 1..4101: mol_type = other DNA
gataaaaaatattcaatcggattggatatcggaacaaactcagtcggatgggcagtcatcacagatgaatataaagtcccatcaaaaaaattcaaagtcttgggaaacacagatagacattcaatcaaaaaaaacttgatcggagcattgttgttcgattcaggagaaacagcagaagcaacaagattgaaaagaacagcaagaagaagatatacaagaagaaaaaacagaatctgctatttgcaagaaatcttctcaaacgaaatggcaaaagtcgatgattcattcttccatagattggaagaatcattcttggtcgaagaagataaaaaacatgaaagacatccaatcttcggaaacatcgtcgatgaagtcgcatatcatgaaaaatatccaacaatctatcatttgagaaaaaaattggtcgattcaacagataaagcagatttgagattgatctatttggcattggcacatatgatcaaattcagaggacatttcttgatcgaaggagatttgaacccagataactcagatgtcgataaattgttcatccaattggtccaaacatataaccaattgttcgaagaaaacccaatcaacgcatcaggagtcgatgcaaaagcaatcttgtcagcaagattgtcaaaatcaagaagattggaaaacttgatcgcacaattgccaggagaaaaaaaaaacggattgttcggaaacttgatcgcattgtcattgggattgacaccaaacttcaaatcaaacttcgatttggcagaagatgcaaaattgcaattgtcaaaagatacatatgatgatgatttggataacttgttggcacaaatcggagatcaatatgcagatttgttcttggcagcaaaaaacttgtcagatgcaatcttgttgtcagatatcttgagagtcaacacagaaatcacaaaagcaccattgtcagcatcaatgatcaaaagatatgatgaacatcatcaagatttgacattgttgaaagcattggtcagacaacaattgccagaaaaatataaagaaatcttcttcgatcaatcaaaaaacggatatgcaggatatatcgatggaggagcatcacaagaagaattctataaattcatcaaaccaatcttggaaaaaatggatggaacagaagaattgttggtcaaattgaacagagaagatttgttgagaaaacaaagaacattcgataacggatcaatcccacatcaaatccatttgggagaattgcatgcaatcttgagaagacaagaagatttctatccattcttgaaagataacagagaaaaaatcgaaaaaatcttgacattcagaatcccatattatgtcggaccattggcaagaggaaactcaagattcgcatggatgacaagaaaatcagaagaaacaatcacaccatggaacttcgaagaagtcgtcgataaaggagcatcagcacaatcattcatcgaaagaatgacaaacttcgataaaaacttgccaaacgaaaaagtcttgccaaaacattcattgttgtatgaatatttcacagtctataacgaattgacaaaagtcaaatatgtcacagaaggaatgagaaaaccagcattcttgtcaggagaacaaaaaaaagcaatcgtcgatttgttgttcaaaacaaacagaaaagtcacagtcaaacaattgaaagaagattatttcaaaaaaatcgaatgcttcgattcagtcgaaatctcaggagtcgaagatagattcaacgcatcattgggaacatatcatgatttgttgaaaatcatcaaagataaagatttcttggataacgaagaaaacgaagatatcttggaagatatcgtcttgacattgacattgttcgaagatagagaaatgatcgaagaaagattgaaaacatatgcacatttgttcgatgataaagtcatgaaacaattgaaaagaagaagatatacaggatggggaagattgtcaagaaaattgatcaacggaatcagagataaacaatcaggaaaaacaatcttggatttcttgaaatcagatggattcgcaaacagaaacttcatgcaattgatccatgatgattcattgacattcaaagaagatatccaaaaagcacaagtctcaggacaaggagattcattgcatgaacatatcgcaaacttggcaggatcaccagcaatcaaaaaaggaatcttgcaaacagtcaaagtcgtcgatgaattggtcaaagtcatgggaagacataaaccagaaaacatcgtcatcgaaatggcaagagaaaaccaaacaacacaaaaaggacaaaaaaactcaagagaaagaatgaaaagaatcgaagaaggaatcaaagaattgggatcacaaatcttgaaagaacatccagtcgaaaacacacaattgcaaaacgaaaaattgtatttgtattatttgcaaaacggaagagatatgtatgtcgatcaagaattggatatcaacagattgtcagattatgatgtcgatcatatcgtcccacaatcattcttgaaagatgattcaatcgataacaaagtcttgacaagatcagataaaaacagaggaaaatcagataacgtcccatcagaagaagtcgtcaaaaaaatgaaaaactattggagacaattgttgaacgcaaaattgatcacacaaagaaaattcgataacttgacaaaagcagaaagaggaggattgtcagaattggataaagcaggattcatcaaaagacaattggtcgaaacaagacaaatcacaaaacatgtcgcacaaatcttggattcaagaatgaacacaaaatatgatgaaaacgataaattgatcagagaagtcaaagtcatcacattgaaatcaaaattggtttcagatttcagaaaagatttccaattctataaagtcagagaaatcaacaactatcatcatgcacatgatgcatatttgaacgcagtcgtcggaacagcattgatcaaaaaatatccaaaattggaatcagaattcgtctatggagattataaagtctatgatgtcagaaaaatgatcgcaaaatcagaacaagaaatcggaaaagcaacagcaaaatatttcttctattcaaacatcatgaacttcttcaaaacagaaatcacattggcaaacggagaaatcagaaaaagaccattgatcgaaacaaacggagaaacaggagaaatcgtctgggataaaggaagagatttcgcaacagtcagaaaagtcttgtcaatgccacaagtcaacatcgtcaaaaaaacagaagtccaaacaggaggattctcaaaagaatcaatcttgccaaaaagaaactcagataaattgatcgcaagaaaaaaagattgggatccaaaaaaatatggaggattcgattcaccaacagtcgcatattcagtcttggtcgtcgcaaaagtcgaaaaaggaaaatcaaaaaaattgaaatcagtcaaagaattgttgggaatcacaatcatggaaagatcatcattcgaaaaaaacccaatcgatttcttggaagcaaaaggatataaagaagtcaaaaaagatttgatcatcaaattgccaaaatattcattgttcgaattggaaaacggaagaaaaagaatgttggcatcagcaggagaattgcaaaaaggaaacgaattggcattgccatcaaaatatgtcaacttcttgtatttggcatcacattatgaaaaattgaaaggatcaccagaagataacgaacaaaaacaattgttcgtcgaacaacataaacattatttggatgaaatcatcgaacaaatctcagaattctcaaaaagagtcatcttggcagatgcaaacttggataaagtcttgtcagcatataacaaacatagagataaaccaatcagagaacaagcagaaaacatcatccatttgttcacattgacaaacttgggagcaccagcagcattcaaatatttcgatacaacaatcgatagaaaaagatatacatcaacaaaagaagtcttggatgcaacattgatccatcaatcaatcacaggattgtatgaaacaagaatcgatttgtcacaattgggaggagat

SEQ ID NO: 204 - DNA, 214 bp, synthetic construct; identical to SEQ ID NO: 193
  source 1..214: mol_type = other DNA

SEQ ID NO: 205 - DNA, 745 bp, synthetic construct
  source 1..745: mol_type = other DNA
tgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagat

SEQ ID NO: 206 - DNA, 1026 bp, synthetic construct
  source 1..1026: mol_type = other DNA
atgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatag

SEQ ID NO: 207 - DNA, 214 bp, synthetic construct; identical to SEQ ID NO: 193
  source 1..214: mol_type = other DNA

SEQ ID NO: 208-249 - skipped (42 entries)

SEQ ID NO: 250 - DNA, 300 bp, synthetic construct
  source 1..300: mol_type = other DNA
cgatttctttagggccgtaggctagtaatcatcgaccgttttaatcattaatgtacttagacaataaatataagatgcaatacaagtcaatgggagaaactagactttacaaaacctttaaaagccctggtgagatatgagaaggtttatgacagaatatatcgccattaatgtgaggttgtggacactgctggtagtcaaggctgcccgtgaaccatatttagtcacatgtaatcaccccgcgtgctaaacaaaaagcaaaatatcagtaagatagtcacagtcataacactgttgaat

SEQ ID NO: 251 - DNA, 300 bp, synthetic construct
  source 1..300: mol_type = other DNA
tgccaaaaagccttcttgtggcctgcttactattaaggcaactaattcaagaacaagtgattctgggtaggtagatgccacagttcatgataataaaggcgaagtcagaaggagtagtccgttgatgaagaaagcagaaggcaaggaatgttggtggcttttggttgcggtagcactgaaaccgtgtccggacttcgccgggagcagacaatggcttggttggattacataataataccccgcgggccagacaatattcaaaatcctaacaaagatgtctcaggtaatacattcgctaat

SEQ ID NO: 252 - DNA, 300 bp, synthetic construct
  source 1..300: mol_type = other DNA
ggtaccagcagtaccagcaccagccactgcattattgaatctgacatctgcaacagcaaggtacaatttttgttttacattttactcattaatattagcacctatagctgtggccaatcttttgacgacgactctctcacgctggaggaaagcatggtacgggcattaattgccagcgtagaacaagcgtaggatatgggcaacctcgctgatttctatatttggtaagaagtctcaccccgtgagctaagcaaaaagcaaaacccttgctatgtcaacatcccactgccatacactatt

SEQ ID NO: 253 - DNA, 573 bp, synthetic construct
  source 1..573: mol_type = other DNA
gagctctgaaagacgcagccgacggtaaacacccgggcatcgagaaaggcattgtcgactatacggaagaagacgttgtttccaccgatttcgttgggagcaactattcgatgatctttgacgcaaaagcgggcatcgcgttgaactcgcgttttatgaaattagttgcatggtatgataatgagtggggatatgcgcgtagagtctgcgatgaggttgtgtatgtagcgaagaagaattaagaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccggtaccatggtttgtctctcgcttgcataccacccagcagctcactgatgtcgacttgtaggttaaa

SEQ ID NO: 254 - DNA, 61 bp, synthetic construct
  source 1..61: mol_type = other DNA
atggtttgtctctcgcttgcataccacccagcagctcactgatgtcgacttgtaggttaaa

SEQ ID NO: 255-299 - skipped (45 entries)

SEQ ID NO: 300 - DNA, 3525 bp, synthetic construct
  source 1..3525: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcaggctcgatttctttagggccgtaggctagtaatcatcgaccgttttaatcattaatgtacttagacaataaatataagatgcaatacaagtcaatgggagaaactagactttacaaaacctttaaaagccctggtgagatatgagaaggtttatgacagaatatatcgccattaatgtgaggttgtggacactgctggtagtcaaggctgcccgtgaaccatatttagtcacatgtaatcaccccgcgtgctaaacaaaaagcaaaatatcagtaagatagtcacagtcataacactgttgaatgggtcttcgccggatccagtgctaacatggtctagaaggaggtcagctatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccagtggtgcatatcggggatgaaagctggcgcatgatgaccaccgatatggccagtgtgccagtctccgttatcggggaagaagtggctgatctcagccaccgcgaaaatgacatcaaaaacgccattaacctgatgttctggggaatataactgcagaggaggtaatcaagaagacctgttttagagctagaaatagcaagttaaaataaggctagtccgttatcaacttgaaaaagtggcaccgagtcggtgcttttttatgccacaacactggtggtacctcagtgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 301 - DNA, 3525 bp, synthetic construct
  source 1..3525: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcaggcttgccaaaaagccttcttgtggcctgcttactattaaggcaactaattcaagaacaagtgattctgggtaggtagatgccacagttcatgataataaaggcgaagtcagaaggagtagtccgttgatgaagaaagcagaaggcaaggaatgttggtggcttttggttgcggtagcactgaaaccgtgtccggacttcgccgggagcagacaatggcttggttggattacataataataccccgcgggccagacaatattcaaaatcctaacaaagatgtctcaggtaatacattcgctaatgggtcttcgccggatccagtgctaacatggtctagaaggaggtcagctatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccagtggtgcatatcggggatgaaagctggcgcatgatgaccaccgatatggccagtgtgccagtctccgttatcggggaagaagtggctgatctcagccaccgcgaaaatgacatcaaaaacgccattaacctgatgttctggggaatataactgcagaggaggtaatcaagaagacctgttttagagctagaaatagcaagttaaaataaggctagtccgttatcaacttgaaaaagtggcaccgagtcggtgcttttttatgccacaacactggtggtacctcagtgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 302 - DNA, 1026 bp, synthetic construct; identical to SEQ ID NO: 206
  source 1..1026: mol_type = other DNA

SEQ ID NO: 303 - DNA, 3525 bp, synthetic construct
  source 1..3525: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcatcagcgatttctttagggccgtaggctagtaatcatcgaccgttttaatcattaatgtacttagacaataaatataagatgcaatacaagtcaatgggagaaactagactttacaaaacctttaaaagccctggtgagatatgagaaggtttatgacagaatatatcgccattaatgtgaggttgtggacactgctggtagtcaaggctgcccgtgaaccatatttagtcacatgtaatcaccccgcgtgctaaacaaaaagcaaaatatcagtaagatagtcacagtcataacactgttgaatgggtcttcgccggatccagtgctaacatggtctagaaggaggtcagctatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccagtggtgcatatcggggatgaaagctggcgcatgatgaccaccgatatggccagtgtgccagtctccgttatcggggaagaagtggctgatctcagccaccgcgaaaatgacatcaaaaacgccattaacctgatgttctggggaatataactgcagaggaggtaatcaagaagacctgttttagagctagaaatagcaagttaaaataaggctagtccgttatcaacttgaaaaagtggcaccgagtcggtgcttttttatgccacaacactggtggtaccctgctgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 304 - DNA, 3525 bp, synthetic construct
  source 1..3525: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcatcagtgccaaaaagccttcttgtggcctgcttactattaaggcaactaattcaagaacaagtgattctgggtaggtagatgccacagttcatgataataaaggcgaagtcagaaggagtagtccgttgatgaagaaagcagaaggcaaggaatgttggtggcttttggttgcggtagcactgaaaccgtgtccggacttcgccgggagcagacaatggcttggttggattacataataataccccgcgggccagacaatattcaaaatcctaacaaagatgtctcaggtaatacattcgctaatgggtcttcgccggatccagtgctaacatggtctagaaggaggtcagctatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccagtggtgcatatcggggatgaaagctggcgcatgatgaccaccgatatggccagtgtgccagtctccgttatcggggaagaagtggctgatctcagccaccgcgaaaatgacatcaaaaacgccattaacctgatgttctggggaatataactgcagaggaggtaatcaagaagacctgttttagagctagaaatagcaagttaaaataaggctagtccgttatcaacttgaaaaagtggcaccgagtcggtgcttttttatgccacaacactggtggtaccctgctgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 305 - DNA, 3525 bp, synthetic construct
  source 1..3525: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcatcagggtaccagcagtaccagcaccagccactgcattattgaatctgacatctgcaacagcaaggtacaatttttgttttacattttactcattaatattagcacctatagctgtggccaatcttttgacgacgactctctcacgctggaggaaagcatggtacgggcattaattgccagcgtagaacaagcgtaggatatgggcaacctcgctgatttctatatttggtaagaagtctcaccccgtgagctaagcaaaaagcaaaacccttgctatgtcaacatcccactgccatacactattgggtcttcgccggatccagtgctaacatggtctagaaggaggtcagctatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccagtggtgcatatcggggatgaaagctggcgcatgatgaccaccgatatggccagtgtgccagtctccgttatcggggaagaagtggctgatctcagccaccgcgaaaatgacatcaaaaacgccattaacctgatgttctggggaatataactgcagaggaggtaatcaagaagacctgttttagagctagaaatagcaagttaaaataaggctagtccgttatcaacttgaaaaagtggcaccgagtcggtgcttttttatgccacaacactggtggtaccctgctgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 306 - DNA, 7793 bp, synthetic construct
  source 1..7793: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcactgcgagctctgaaagacgcagccgacggtaaacacccgggcatcgagaaaggcattgtcgactatacggaagaagacgttgtttccaccgatttcgttgggagcaactattcgatgatctttgacgcaaaagcgggcatcgcgttgaactcgcgttttatgaaattagttgcatggtatgataatgagtggggatatgcgcgtagagtctgcgatgaggttgtgtatgtagcgaagaagaattaagaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccggtaccatggtttgtctctcgcttgcataccacccagcagctcactgatgtcgacttgtaggttaaagattataaagatcatgatggagattataaagatcatgatatcgattataaagatgatgatgataaagcagcaccaaaaaaaaaaagaaaagtcggaatccatggagtcccagcagcagataaaaaatattcaatcggattggatatcggaacaaactcagtcggatgggcagtcatcacagatgaatataaagtcccatcaaaaaaattcaaagtcttgggaaacacagatagacattcaatcaaaaaaaacttgatcggagcattgttgttcgattcaggagaaacagcagaagcaacaagattgaaaagaacagcaagaagaagatatacaagaagaaaaaacagaatctgctatttgcaagaaatcttctcaaacgaaatggcaaaagtcgatgattcattcttccatagattggaagaatcattcttggtcgaagaagataaaaaacatgaaagacatccaatcttcggaaacatcgtcgatgaagtcgcatatcatgaaaaatatccaacaatctatcatttgagaaaaaaattggtcgattcaacagataaagcagatttgagattgatctatttggcattggcacatatgatcaaattcagaggacatttcttgatcgaaggagatttgaacccagataactcagatgtcgataaattgttcatccaattggtccaaacatataaccaattgttcgaagaaaacccaatcaacgcatcaggagtcgatgcaaaagcaatcttgtcagcaagattgtcaaaatcaagaagattggaaaacttgatcgcacaattgccaggagaaaaaaaaaacggattgttcggaaacttgatcgcattgtcattgggattgacaccaaacttcaaatcaaacttcgatttggcagaagatgcaaaattgcaattgtcaaaagatacatatgatgatgatttggataacttgttggcacaaatcggagatcaatatgcagatttgttcttggcagcaaaaaacttgtcagatgcaatcttgttgtcagatatcttgagagtcaacacagaaatcacaaaagcaccattgtcagcatcaatgatcaaaagatatgatgaacatcatcaagatttgacattgttgaaagcattggtcagacaacaattgccagaaaaatataaagaaatcttcttcgatcaatcaaaaaacggatatgcaggatatatcgatggaggagcatcacaagaagaattctataaattcatcaaaccaatcttggaaaaaatggatggaacagaagaattgttggtcaaattgaacagagaagatttgttgagaaaacaaagaacattcgataacggatcaatcccacatcaaatccatttgggagaattgcatgcaatcttgagaagacaagaagatttctatccattcttgaaagataacagagaaaaaatcgaaaaaatcttgacattcagaatcccatattatgtcggaccattggcaagaggaaactcaagattcgcatggatgacaagaaaatcagaagaaacaatcacaccatggaacttcgaagaagtcgtcgataaaggagcatcagcacaatcattcatcgaaagaatgacaaacttcgataaaaacttgccaaacgaaaaagtcttgccaaaacattcattgttgtatgaatatttcacagtctataacgaattgacaaaagtcaaatatgtcacagaaggaatgagaaaaccagcattcttgtcaggagaacaaaaaaaagcaatcgtcgatttgttgttcaaaacaaacagaaaagtcacagtcaaacaattgaaagaagattatttcaaaaaaatcgaatgcttcgattcagtcgaaatctcaggagtcgaagatagattcaacgcatcattgggaacatatcatgatttgttgaaaatcatcaaagataaagatttcttggataacgaagaaaacgaagatatcttggaagatatcgtcttgacattgacattgttcgaagatagagaaatgatcgaagaaagattgaaaacatatgcacatttgttcgatgataaagtcatgaaacaattgaaaagaagaagatatacaggatggggaagattgtcaagaaaattgatcaacggaatcagagataaacaatcaggaaaaacaatcttggatttcttgaaatcagatggattcgcaaacagaaacttcatgcaattgatccatgatgattcattgacattcaaagaagatatccaaaaagcacaagtctcaggacaaggagattcattgcatgaacatatcgcaaacttggcaggatcaccagcaatcaaaaaaggaatcttgcaaacagtcaaagtcgtcgatgaattggtcaaagtcatgggaagacataaaccagaaaacatcgtcatcgaaatggcaagagaaaaccaaacaacacaaaaaggacaaaaaaactcaagagaaagaatgaaaagaatcgaagaaggaatcaaagaattgggatcacaaatcttgaaagaacatccagtcgaaaacacacaattgcaaaacgaaaaattgtatttgtattatttgcaaaacggaagagatatgtatgtcgatcaagaattggatatcaacagattgtcagattatgatgtcgatcatatcgtcccacaatcattcttgaaagatgattcaatcgataacaaagtcttgacaagatcagataaaaacagaggaaaatcagataacgtcccatcagaagaagtcgtcaaaaaaatgaaaaactattggagacaattgttgaacgcaaaattgatcacacaaagaaaattcgataacttgacaaaagcagaaagaggaggattgtcagaattggataaagcaggattcatcaaaagacaattggtcgaaacaagacaaatcacaaaacatgtcgcacaaatcttggattcaagaatgaacacaaaatatgatgaaaacgataaattgatcagagaagtcaaagtcatcacattgaaatcaaaattggtttcagatttcagaaaagatttccaattctataaagtcagagaaatcaacaactatcatcatgcacatgatgcatatttgaacgcagtcgtcggaacagcattgatcaaaaaatatccaaaattggaatcagaattcgtctatggagattataaagtctatgatgtcagaaaaatgatcgcaaaatcagaacaagaaatcggaaaagcaacagcaaaatatttcttctattcaaacatcatgaacttcttcaaaacagaaatcacattggcaaacggagaaatcagaaaaagaccattgatcgaaacaaacggagaaacaggagaaatcgtctgggataaaggaagagatttcgcaacagtcagaaaagtcttgtcaatgccacaagtcaacatcgtcaaaaaaacagaagtccaaacaggaggattctcaaaagaatcaatcttgccaaaaagaaactcagataaattgatcgcaagaaaaaaagattgggatccaaaaaaatatggaggattcgattcaccaacagtcgcatattcagtcttggtcgtcgcaaaagtcgaaaaaggaaaatcaaaaaaattgaaatcagtcaaagaattgttgggaatcacaatcatggaaagatcatcattcgaaaaaaacccaatcgatttcttggaagcaaaaggatataaagaagtcaaaaaagatttgatcatcaaattgccaaaatattcattgttcgaattggaaaacggaagaaaaagaatgttggcatcagcaggagaattgcaaaaaggaaacgaattggcattgccatcaaaatatgtcaacttcttgtatttggcatcacattatgaaaaattgaaaggatcaccagaagataacgaacaaaaacaattgttcgtcgaacaacataaacattatttggatgaaatcatcgaacaaatctcagaattctcaaaaagagtcatcttggcagatgcaaacttggataaagtcttgtcagcatataacaaacatagagataaaccaatcagagaacaagcagaaaacatcatccatttgttcacattgacaaacttgggagcaccagcagcattcaaatatttcgatacaacaatcgatagaaaaagatatacatcaacaaaagaagtcttggatgcaacattgatccatcaatcaatcacaggattgtatgaaacaagaatcgatttgtcacaattgggaggagatggaatccatggagtcccagcagcaccaaaaaaaaaaagaaaagtctgaagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcactatgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 307 - DNA, 7793 bp, synthetic construct
  source 1..7793: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcactgcgagctctgaaagacgcagccgacggtaaacacccgggcatcgagaaaggcattgtcgactatacggaagaagacgttgtttccaccgatttcgttgggagcaactattcgatgatctttgacgcaaaagcgggcatcgcgttgaactcgcgttttatgaaattagttgcatggtatgataatgagtggggatatgcgcgtagagtctgcgatgaggttgtgtatgtagcgaagaagaattaagaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccggtaccatggtttgtctctcgcttgcataccacccagcagctcactgatgtcgacttgtaggttaaagattataaagatcatgatggagattataaagatcatgatatcgattataaagatgatgatgataaagcagcaccaaaaaaaaaaagaaaagtcggaatccatggagtcccagcagcagataaaaaatattcaatcggattggcaatcggaacaaactcagtcggatgggcagtcatcacagatgaatataaagtcccatcaaaaaaattcaaagtcttgggaaacacagatagacattcaatcaaaaaaaacttgatcggagcattgttgttcgattcaggagaaacagcagaagcaacaagattgaaaagaacagcaagaagaagatatacaagaagaaaaaacagaatctgctatttgcaagaaatcttctcaaacgaaatggcaaaagtcgatgattcattcttccatagattggaagaatcattcttggtcgaagaagataaaaaacatgaaagacatccaatcttcggaaacatcgtcgatgaagtcgcatatcatgaaaaatatccaacaatctatcatttgagaaaaaaattggtcgattcaacagataaagcagatttgagattgatctatttggcattggcacatatgatcaaattcagaggacatttcttgatcgaaggagatttgaacccagataactcagatgtcgataaattgttcatccaattggtccaaacatataaccaattgttcgaagaaaacccaatcaacgcatcaggagtcgatgcaaaagcaatcttgtcagcaagattgtcaaaatcaagaagattggaaaacttgatcgcacaattgccaggagaaaaaaaaaacggattgttcggaaacttgatcgcattgtcattgggattgacaccaaacttcaaatcaaacttcgatttggcagaagatgcaaaattgcaattgtcaaaagatacatatgatgatgatttggataacttgttggcacaaatcggagatcaatatgcagatttgttcttggcagcaaaaaacttgtcagatgcaatcttgttgtcagatatcttgagagtcaacacagaaatcacaaaagcaccattgtcagcatcaatgatcaaaagatatgatgaacatcatcaagatttgacattgttgaaagcattggtcagacaacaattgccagaaaaatataaagaaatcttcttcgatcaatcaaaaaacggatatgcaggatatatcgatggaggagcatcacaagaagaattctataaattcatcaaaccaatcttggaaaaaatggatggaacagaagaattgttggtcaaattgaacagagaagatttgttgagaaaacaaagaacattcgataacggatcaatcccacatcaaatccatttgggagaattgcatgcaatcttgagaagacaagaagatttctatccattcttgaaagataacagagaaaaaatcgaaaaaatcttgacattcagaatcccatattatgtcggaccattggcaagaggaaactcaagattcgcatggatgacaagaaaatcagaagaaacaatcacaccatggaacttcgaagaagtcgtcgataaaggagcatcagcacaatcattcatcgaaagaatgacaaacttcgataaaaacttgccaaacgaaaaagtcttgccaaaacattcattgttgtatgaatatttcacagtctataacgaattgacaaaagtcaaatatgtcacagaaggaatgagaaaaccagcattcttgtcaggagaacaaaaaaaagcaatcgtcgatttgttgttcaaaacaaacagaaaagtcacagtcaaacaattgaaagaagattatttcaaaaaaatcgaatgcttcgattcagtcgaaatctcaggagtcgaagatagattcaacgcatcattgggaacatatcatgatttgttgaaaatcatcaaagataaagatttcttggataacgaagaaaacgaagatatcttggaagatatcgtcttgacattgacattgttcgaagatagagaaatgatcgaagaaagattgaaaacatatgcacatttgttcgatgataaagtcatgaaacaattgaaaagaagaagatatacaggatggggaagattgtcaagaaaattgatcaacggaatcagagataaacaatcaggaaaaacaatcttggatttcttgaaatcagatggattcgcaaacagaaacttcatgcaattgatccatgatgattcattgacattcaaagaagatatccaaaaagcacaagtctcaggacaaggagattcattgcatgaacatatcgcaaacttggcaggatcaccagcaatcaaaaaaggaatcttgcaaacagtcaaagtcgtcgatgaattggtcaaagtcatgggaagacataaaccagaaaacatcgtcatcgaaatggcaagagaaaaccaaacaacacaaaaaggacaaaaaaactcaagagaaagaatgaaaagaatcgaagaaggaatcaaagaattgggatcacaaatcttgaaagaacatccagtcgaaaacacacaattgcaaaacgaaaaattgtatttgtattatttgcaaaacggaagagatatgtatgtcgatcaagaattggatatcaacagattgtcagattatgatgtcgatcatatcgtcccacaatcattcttgaaagatgattcaatcgataacaaagtcttgacaagatcagataaaaacagaggaaaatcagataacgtcccatcagaagaagtcgtcaaaaaaatgaaaaactattggagacaattgttgaacgcaaaattgatcacacaaagaaaattcgataacttgacaaaagcagaaagaggaggattgtcagaattggataaagcaggattcatcaaaagacaattggtcgaaacaagacaaatcacaaaacatgtcgcacaaatcttggattcaagaatgaacacaaaatatgatgaaaacgataaattgatcagagaagtcaaagtcatcacattgaaatcaaaattggtttcagatttcagaaaagatttccaattctataaagtcagagaaatcaacaactatcatcatgcacatgatgcatatttgaacgcagtcgtcggaacagcattgatcaaaaaatatccaaaattggaatcagaattcgtctatggagattataaagtctatgatgtcagaaaaatgatcgcaaaatcagaacaagaaatcggaaaagcaacagcaaaatatttcttctattcaaacatcatgaacttcttcaaaacagaaatcacattggcaaacggagaaatcagaaaaagaccattgatcgaaacaaacggagaaacaggagaaatcgtctgggataaaggaagagatttcgcaacagtcagaaaagtcttgtcaatgccacaagtcaacatcgtcaaaaaaacagaagtccaaacaggaggattctcaaaagaatcaatcttgccaaaaagaaactcagataaattgatcgcaagaaaaaaagattgggatccaaaaaaatatggaggattcgattcaccaacagtcgcatattcagtcttggtcgtcgcaaaagtcgaaaaaggaaaatcaaaaaaattgaaatcagtcaaagaattgttgggaatcacaatcatggaaagatcatcattcgaaaaaaacccaatcgatttcttggaagcaaaaggatataaagaagtcaaaaaagatttgatcatcaaattgccaaaatattcattgttcgaattggaaaacggaagaaaaagaatgttggcatcagcaggagaattgcaaaaaggaaacgaattggcattgccatcaaaatatgtcaacttcttgtatttggcatcacattatgaaaaattgaaaggatcaccagaagataacgaacaaaaacaattgttcgtcgaacaacataaacattatttggatgaaatcatcgaacaaatctcagaattctcaaaaagagtcatcttggcagatgcaaacttggataaagtcttgtcagcatataacaaacatagagataaaccaatcagagaacaagcagaaaacatcatccatttgttcacattgacaaacttgggagcaccagcagcattcaaatatttcgatacaacaatcgatagaaaaagatatacatcaacaaaagaagtcttggatgcaacattgatccatcaatcaatcacaggattgtatgaaacaagaatcgatttgtcacaattgggaggagatggaatccatggagtcccagcagcaccaaaaaaaaaaagaaaagtctgaagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcactatgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 308 - DNA, 4725 bp, synthetic construct
  source 1..4725: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcaactatgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcgtattgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 309 - DNA, 3525 bp, synthetic construct
  source 1..3525: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcaacctcgatttctttagggccgtaggctagtaatcatcgaccgttttaatcattaatgtacttagacaataaatataagatgcaatacaagtcaatgggagaaactagactttacaaaacctttaaaagccctggtgagatatgagaaggtttatgacagaatatatcgccattaatgtgaggttgtggacactgctggtagtcaaggctgcccgtgaaccatatttagtcacatgtaatcaccccgcgtgctaaacaaaaagcaaaatatcagtaagatagtcacagtcataacactgttgaatgggtcttcgccggatccagtgctaacatggtctagaaggaggtcagctatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccagtggtgcatatcggggatgaaagctggcgcatgatgaccaccgatatggccagtgtgccagtctccgttatcggggaagaagtggctgatctcagccaccgcgaaaatgacatcaaaaacgccattaacctgatgttctggggaatataactgcagaggaggtaatcaagaagacctgttttagagctagaaatagcaagttaaaataaggctagtccgttatcaacttgaaaaagtggcaccgagtcggtgcttttttatgccacaacactggtggtaccaacatgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 310 - DNA, 3525 bp, synthetic construct
  source 1..3525: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcaaccttgccaaaaagccttcttgtggcctgcttactattaaggcaactaattcaagaacaagtgattctgggtaggtagatgccacagttcatgataataaaggcgaagtcagaaggagtagtccgttgatgaagaaagcagaaggcaaggaatgttggtggcttttggttgcggtagcactgaaaccgtgtccggacttcgccgggagcagacaatggcttggttggattacataataataccccgcgggccagacaatattcaaaatcctaacaaagatgtctcaggtaatacattcgctaatgggtcttcgccggatccagtgctaacatggtctagaaggaggtcagctatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccagtggtgcatatcggggatgaaagctggcgcatgatgaccaccgatatggccagtgtgccagtctccgttatcggggaagaagtggctgatctcagccaccgcgaaaatgacatcaaaaacgccattaacctgatgttctggggaatataactgcagaggaggtaatcaagaagacctgttttagagctagaaatagcaagttaaaataaggctagtccgttatcaacttgaaaaagtggcaccgagtcggtgcttttttatgccacaacactggtggtaccaacatgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 311 - DNA, 3525 bp, synthetic construct
  source 1..3525: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcaacctggtaccagcagtaccagcaccagccactgcattattgaatctgacatctgcaacagcaaggtacaatttttgttttacattttactcattaatattagcacctatagctgtggccaatcttttgacgacgactctctcacgctggaggaaagcatggtacgggcattaattgccagcgtagaacaagcgtaggatatgggcaacctcgctgatttctatatttggtaagaagtctcaccccgtgagctaagcaaaaagcaaaacccttgctatgtcaacatcccactgccatacactattgggtcttcgccggatccagtgctaacatggtctagaaggaggtcagctatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccagtggtgcatatcggggatgaaagctggcgcatgatgaccaccgatatggccagtgtgccagtctccgttatcggggaagaagtggctgatctcagccaccgcgaaaatgacatcaaaaacgccattaacctgatgttctggggaatataactgcagaggaggtaatcaagaagacctgttttagagctagaaatagcaagttaaaataaggctagtccgttatcaacttgaaaaagtggcaccgagtcggtgcttttttatgccacaacactggtggtaccaacatgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 312 - DNA, 3525 bp, synthetic construct
  source 1..3525: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcaaacacgatttctttagggccgtaggctagtaatcatcgaccgttttaatcattaatgtacttagacaataaatataagatgcaatacaagtcaatgggagaaactagactttacaaaacctttaaaagccctggtgagatatgagaaggtttatgacagaatatatcgccattaatgtgaggttgtggacactgctggtagtcaaggctgcccgtgaaccatatttagtcacatgtaatcaccccgcgtgctaaacaaaaagcaaaatatcagtaagatagtcacagtcataacactgttgaatgggtcttcgccggatccagtgctaacatggtctagaaggaggtcagctatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccagtggtgcatatcggggatgaaagctggcgcatgatgaccaccgatatggccagtgtgccagtctccgttatcggggaagaagtggctgatctcagccaccgcgaaaatgacatcaaaaacgccattaacctgatgttctggggaatataactgcagaggaggtaatcaagaagacctgttttagagctagaaatagcaagttaaaataaggctagtccgttatcaacttgaaaaagtggcaccgagtcggtgcttttttatgccacaacactggtggtaccggcttgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 313 - DNA, 3525 bp, synthetic construct
  source 1..3525: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcaaacatgccaaaaagccttcttgtggcctgcttactattaaggcaactaattcaagaacaagtgattctgggtaggtagatgccacagttcatgataataaaggcgaagtcagaaggagtagtccgttgatgaagaaagcagaaggcaaggaatgttggtggcttttggttgcggtagcactgaaaccgtgtccggacttcgccgggagcagacaatggcttggttggattacataataataccccgcgggccagacaatattcaaaatcctaacaaagatgtctcaggtaatacattcgctaatgggtcttcgccggatccagtgctaacatggtctagaaggaggtcagctatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccagtggtgcatatcggggatgaaagctggcgcatgatgaccaccgatatggccagtgtgccagtctccgttatcggggaagaagtggctgatctcagccaccgcgaaaatgacatcaaaaacgccattaacctgatgttctggggaatataactgcagaggaggtaatcaagaagacctgttttagagctagaaatagcaagttaaaataaggctagtccgttatcaacttgaaaaagtggcaccgagtcggtgcttttttatgccacaacactggtggtaccggcttgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 314 - skipped

SEQ ID NO: 315 - DNA, 61 bp, synthetic construct; identical to SEQ ID NO: 254
  source 1..61: mol_type = other DNA

SEQ ID NO: 316-399 - skipped (84 entries)

SEQ ID NO: 400 - DNA, 300 bp, synthetic construct; identical to SEQ ID NO: 250
  source 1..300: mol_type = other DNA

SEQ ID NO: 401 - DNA, 300 bp, synthetic construct; identical to SEQ ID NO: 251
  source 1..300: mol_type = other DNA

SEQ ID NO: 402 - DNA, 3525 bp, synthetic construct
  source 1..3525: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcaggctggtaccagcagtaccagcaccagccactgcattattgaatctgacatctgcaacagcaaggtacaatttttgttttacattttactcattaatattagcacctatagctgtggccaatcttttgacgacgactctctcacgctggaggaaagcatggtacgggcattaattgccagcgtagaacaagcgtaggatatgggcaacctcgctgatttctatatttggtaagaagtctcaccccgtgagctaagcaaaaagcaaaacccttgctatgtcaacatcccactgccatacactattgggtcttcgccggatccagtgctaacatggtctagaaggaggtcagctatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccagtggtgcatatcggggatgaaagctggcgcatgatgaccaccgatatggccagtgtgccagtctccgttatcggggaagaagtggctgatctcagccaccgcgaaaatgacatcaaaaacgccattaacctgatgttctggggaatataactgcagaggaggtaatcaagaagacctgttttagagctagaaatagcaagttaaaataaggctagtccgttatcaacttgaaaaagtggcaccgagtcggtgcttttttatgccacaacactggtggtacctcagtgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 403 - DNA, 300 bp, synthetic construct; identical to SEQ ID NO: 252
  source 1..300: mol_type = other DNA

SEQ ID NO: 404 - DNA, 365 bp, synthetic construct
  source 1..365: mol_type = other DNA
gccggatccagtgctaacatggtctagaaggaggtcagctatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccagtggtgcatatcggggatgaaagctggcgcatgatgaccaccgatatggccagtgtgccagtctccgttatcggggaagaagtggctgatctcagccaccgcgaaaatgacatcaaaaacgccattaacctgatgttctggggaatataactgcagaggaggtaatcaa

SEQ ID NO: 405 - DNA, 82 bp, synthetic construct
  source 1..82: mol_type = other DNA
gttttagagctagaaatagcaagttaaaataaggctagtccgttatcaacttgaaaaagtggcaccgagtcggtgctttttt

SEQ ID NO: 406 - DNA, 573 bp, unidentified; identical to SEQ ID NO: 253
  source 1..573: mol_type = unassigned DNA

SEQ ID NO: 407-449 - skipped (43 entries)

SEQ ID NO: 450 - DNA, 52 bp, synthetic construct
  source 1..52: mol_type = other DNA
gtttgtctctcgcttgcataccacccagcagctcactgatgtcgacttgtag

SEQ ID NO: 451-459 - skipped (9 entries)

SEQ ID NO: 460 - DNA, 609 bp, synthetic construct
  source 1..609: mol_type = other DNA
atagttgcttgaatgcgccgcccgtcaaaaaagaaaatcgaactttttatagtgtaatggtatcaagtttagaatatgtgctgttctgtgatttcatttctgtttagaagtgcgttaagggatgatatattgatacattgatggatgtcagaaatgcatgaatcaatgtgcttttttgaatggcgtgaagtttttcagtacccgggacctggccatgggccatggcatggactcggagatccgacagaaagtcacgggagtgttgtgtgtagtcacgtgagcaacgcgagcgacgcggttgacgggcgtccatttttgactttcttgttctcatcacactccaaccatcttcttccatcgccgttgcctcccctttttttacccgacttttcctggcagactttgaactatttgaaccaggatgtgggcaaagttcagttccgcattgaaatcgacaacgacgaggcctcaagagcctgaagagacaagatccacaacaccggtgcattttggtccgtcgcgggctgaaacaccgcagagtatcgggcgtagccaggcagaagttaccgctcacttactgggagaaagtagttctgactcgactgcttt

SEQ ID NO: 461 - DNA, 505 bp, synthetic construct
  source 1..505: mol_type = other DNA
aaaaaaatttgattgtgtacactaacacttttcctattcgctcaggtggcacgatcgattttccaacagtagaaagctttgtcgttataattctcgctatctttgcacatatctgtcattcctatctgggcttattacacctgcatactgtattgtaacaacattacctttttttatcacttttcggctttcagatactttgttgtggctttttttctatttcaactttcactttatgcccttctgaatgaacaccttgtcactgcttctgcaatgtttctgtgtgactgctcagtctcgtggtcgtgtgacattcgtggtgatatgcagcgttcggttaagtcgcgacttgaagtcctacgataacattgattaaatatgcctcgcgagattgtaactgtccagcttggccaatgtggaaaccagagtacgctttcttgaatatttgggatacaatacgcgtctcatctcttgatgatttttgatcaagtgggctcggtttttt

SEQ ID NO: 462 - DNA, 846 bp, unidentified
  source 1..846: mol_type = unassigned DNA
agtagatgccgaccggatctgtcgatcgacaagctcgagcggccgcagtagatgccgaccgggatccacttaacgttactgaaatcatcaaacagcttgacgaatctggatataagatcgttggtgtcgatgtcagctccggagttgagacaaatggtgttcaggatctcgataagatacgttcatttgtccaagcagcaaagagtgccttctagtgatttaatagctccatgtcaacaagaataaaacgcgtttcgggtttacctcttccagatacagctcatctgcaatgcattaatgcattggacctcgcaaccctagtacgcccttcaggctccggcgaagcagaagaatagcttagcagagtctattttcattttcgggagacgagatcaagcagatcaacggtcgtcaagagacctacgagactgaggaatccgctcttggctccacgcgactatatatttgtctctaattgtactttgacatgctcctcttctttactctgatagcttgactatgaaaattccgtcaccagcccctgggttcgcaaagataattgcactgtttcttccttgaactctcaagcctacaggacacacattcatcgtaggtataaacctcgaaaatcattcctactaagatgggtatacaatagtaaccatgcatggttgcctagtgaatgctccgtaacacccaatacgccggccgaaacttttttacaactctcctatgagtcgtttacccagaatgcacaggtacacttgtttagaggtaatccttctttctagaagtcctcgtgtactgtgtaagcgcccactccacatctccactcgagctagctag

SEQ ID NO: 463-499 - skipped (37 entries)

SEQ ID NO: 500 - DNA, 1246 bp, synthetic construct
  source 1..1246: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgcatatcagaaacccatatagaacaccaatcgattatcaagcactctctgaagcattcccaccactcaaaccattcgtctctgtcaacgcagatggaacatcttctgtcgatctcacaatcccagaagcacaaagagcattcacagcagcactcctccatagagatttcggactcacaatgacaatcccagaagatagactctgcccaacagtcccaaacagactcaactatgtcctctggatcgaagatatcttcaactatacaaacaaaacactcggactctctgatgatagaccaatcagaggagtcgatatcggaacaggagcatctgcaatctatccaatgctcgcatgcgcaagattcaaagcatggtctatggtcggaacagaagtcgaaagaaaatgcatcgatacagcaagactcaacgtcgtcgcaaacaacctccaagatagactctctatcctcgaaacatctatcgatggaccaatcctcgtcccaatcttcgaagcaacagaagaatatgaatatgaattcacaatgtgcaacccaccattctatgatggagcagcagatatgcaaacatctgatgcagcaaaaggattcggattcggagtcggagcaccacattctggaacagtcatcgaaatgtctacagaaggaggagaatctgcattcgtcgcacaaatggtcagagaatctctcaaactcagaacaagatgcagatggtatacatctaacctcggaaaactcaaatctctcaaagaaatcgtcggactcctcaaagaactcgaaatctctaactatgcaatcaacgaatatgtccaaggatctacaagaagatatgcagtcgcatggtctttcacagatatccaactcccagaagaactctctagaccatctaacccagaactctcttctctcttctga

SEQ ID NO: 501 - DNA, 3358 bp, synthetic construct
  source 1..3358: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgccatcttctcatccacatatcacacatagatatagagtcccatcttctgatgatcatgaaagaatctctgcactcttcctcggaccaaaagcagaaaacgcagcattcctccaacaatggctcacaacagtcgtcgcacaacaaaaagcagcaagagatgcatatttcccagatgataacgcattcatcacaacagatatgcaaacatctccagcattcgcacaaacaacaaaagtcatcgcatctaacctcacagaactcctcacagcactcggagaaagatctatcccattcttctctccaagatattctggacatatgtctgtcgatcaatctctcccagcaatcctcggattcctctctacaacattctataacccaaacaacgtcgcattcgaagcatctccattcacaacactcatcgaagaagaagtcggactccaactctctgaaatgctcggatataacagactcaacaacacagaaaaaccactcgcatggggacatatcgcatctggaggaacagtcgcaaacctcgaagcaatgtgggcagcaagaaacctcaaattctatccactctctctcagagatgcatctgcagaaggagcagaaatggaattcatcagagatacattctctgtcaaaacatgcgtcggagataaaaaactcctcaaagattgctctccatgggaactcctcaacctccatgtctctacaatcctcgatatgccagatagactccatgatgaatataacatctctccacaattcctcgaaaaagtcatgagaaaatatatcatccaatctacaaacaaagatacactcatgcaaagatggggactcacacaacaaccagtcgtcctctctccatctacaaaccattattcttggccaaaagcagcagcagtcctcggaatcggatctgataacctcagaaacgtcccagtcgatatccaagcacatatggatatcaacgaactcgatagaatgctcaaaatctgcctcgatgaagaaacaccagtctatcaagtcgtcgcagtcatcggaacaacagaagaaggaggagtcgatagaatcacagaaatcctcaaactcagacaaaaatatgaagcactcggactctctttcgcaatccatgcagatgcagcatggggaggatatttcgcaacaatgctcccaaaagatacactcggaagaaacagaacaagactcccaaaagaagatacaacatctggattcgtcccacatgtcggactcagagaagaatctgcactccaactctctcatatcaaatatgcagattctatcacaatcgatccacataaagcaggatatgtcccatatccagcaggagcactctgctatagagatggaagaatgagatatctcctcacatggtctgcaccatatctcgcacaaggaaacgaaggacaatctatcggaatctatggaatcgaaggatctaaaccaggagcagcagcatctgcagtcttcatggcacatgaaacaatcggactcacaccatctggatatggaaacctcctcggacaagcaatgttcacatgcagaagatatgcagcacattggtctgcaatgtctacagatacaacatctttcacagtcacaccattcaacccaatcccagcagatatcgatccaaacgcagatccagcaaaagtcgaagaacaaaaacaattcatcagagatagaatcctcttcaaatctaacgaagaaatctataacgattctgaagcaatggaactcctccatcaactcggatctgatctcaacatcaacgtcttcgcatgcaacttcagagatagagataacaacctcaacacagatgtcgaagaagcaaactggctcaacaacagaatcttccaaagattctctgtcacatctgcagaagaaaacccactcgaaacaccattcttcctctcttctacaacactcaaacaatctgaatatggagtctgcgcaacagaagtcaaaagaagaatgggactcgtcggagatcaagatgtcatcgtcctcagaaacgtcgtcatgtctccattcacaacaacaaacgatttcgtcggaacactcgcaaacacattccaaaaaatcgtcgaagaagaagtcgaatatgcaagaatcagaaacgatatgaaaccatctatccatacattcctcctccatggatctggagaacaatattatctcgtccatacaccaacaatccatatggcatctggaagaagacaaatcatcctctctgtcaacgtcgaaggacaagtcagacaagcaatccatgcacatgaaagagtcgaagcagtcatcgtccataacacagtcccactcagactcgatgaaatcgtcgatggaggatctttcgatggaatcctcacaatcggaaaaagaaaaacatctttcaaagtcaaaatctctaacatcaaagtcgtcaaaaaaagatctctcatgacagaagatctcgaatctgcatatccatctctcatgccattctatttctatggaacacaaggacatgcacatctcgatcatgtcatcacagtcgtcccaaacatccatctctctgcaggagaaatccaatataaattcgatgatgaagtctcttctgaagatctcgcaaaaggactcatcgtcgtcgcagaaaacgtccatgaagcatctatgcaaccattcccactcatgaaagatttcaaaatcacaaaccaattcttcttctcttctggacaaatcctcagagtcaaagtctatagagatccatatccagcatctacaatggatccaatcccactccatgatatcaaaaaccaaccagtcgtcacacaaggaacaatcacactcgtcggaaacatctatgtcgattctgatgcactcaacgtcgcatctgaaccaacagcagatgaagatgcagcacatgtcccacatgcaagaaacatgtatggagaaatgacagcaggaacaatcaaaggatggcaaaacgcagtcagacatttccataacaaactcgaaacagtcgcaccaacaaaatag

SEQ ID NO: 502 - DNA, 1255 bp, synthetic construct
  source 1..1255: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgcatatcagaaacccatatagaacaccaatcgattatcaagcactcgtcgaagcattcccaccactcaaaccatatgtcacagtcaaccaagataacacaacatctatcgatctcacagtcccagaagtccaaagactctatacagcagcactcctccatagagatttcggactcgtcatcgatctcccagaagatagactctgcccaacactcctcacaagaacaccatctctcaactatgtcctctgggtcgaagatatcctcaaagtcacaaacacagcactcggactctctgaagatagaccagtcaaaggaatcgatatcggaacaggagcagcagcaatctatccaatgctcgcatgcgcaagattcaaaacatggtctatgatcggaacagaaatcgatagaaaatgcatcgatacagcaagagtcaacgtcctcacaaacaacctccaagatagactctctatcatcgaaacatctatcgatggaccaatcctcgtcccaatcttcgaagcaacaacagattatgaatatgatttcacaatgtgcaacccaccattctatgatggagcagcagatatgcaaacatctgatgcagcaaaaggattcggattcggagtcaacgcaccacattctggaacagtcatcgaaatgtctacagaaggaggagaatctgcattcgtcgcacaaatggtcagagaatctctcgatcatagaacaagatgcagatggttcacatctaacctcggaaaactcaaatctctccatgaaatcgtcggactcctcagagaacatcaaatctctaactatgcaatcaacgaatatgtccaaggaacaacaagaagatatgcaatcgcatggtctttcacaaacatcagactcccagaagatctcacaagaccatctaacccagaactctcttctctcttctga

SEQ ID NO: 503 - DNA, 1393 bp, synthetic construct
  source 1..1393: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgccaagaatccaagtcctcgatatcagaggatctaaagaatctgtcggatctacaccacatctcagagcagcaatcctcgaaggactcctcaaaccaccaggatctagaacactcccatctgaaacactctatgatgaagtcggactcaaaatgtataacgatggaatgaaagcatgggcagaatggtattatccagtcgaagcagaaagacaaatcctcgaaagatatggaagagatatcgcaaaactcttcacaacatctgcaaaaggaaaagcagtcctcatcgaactcggagcaggatctctcgataaaacatctcaagtcctcctctctgcagcagaaatcacaagaacaacaggaccaatgaacaacatcgcatattatgcactcgatctcgaaagaggagaactcgaaagaacaatcggaagactccaagaagtcatcggagatcaaatcgcaggaaaaatctctacagcaggaatgtggggaacatatgatgatggaatcagagtcatcgaaaaaaacgaactcgaactcgaaccagatatcccagtccatatcctcttcctcggaggaacaatcggaaacttctctaaacaagatggagatgtcgcattcctcaaatctctcccactcgatcataaaagaggagatacactcctcgtcggaatggatagacataaatctgcagatgcaatcgaaagatcttatggattcgcagcagcaaaagattggatcatgaacggactcaaagtctctggaagagtcctcacaggagatgaaggactcttcgaaatcggaaactgggaaagatatgcaaaatataacgaagaactcggaagatatgaagcaggatataaatctcaaaaagaacatgcactcaaaatctctgaaggagtcgatatcacattcctcaaagatgaagtcgtcctcgtcatgttctctaacaaatatacagatgcagaaatggattctgtcgtcgattctgcaggactcgtcaaaaacggatcttggatggatgaaaaagcacaatattgcctcctctctctcagagcaaacaacggaccagtctga

SEQ ID NO: 504 - DNA, 1375 bp, synthetic construct
  source 1..1375: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatggcaaacttctctgaatctaaatctatgatggcagtcttcttcatgttcttcctcctcctcctctcttcttcttcttcttcttcttcttcttctccaatcctcaaaaaaatcttcatcgaatctccatcttatgcaccaaacgcattcacattcgattctacagataaaggattctatacatctgtccaagatggaagagtcatcaaatatgaaggaccaaactctggattcacagatttcgcatatgcatctccattctggaacaaagcattctgcgaaaactctacagatccagaaaaaagaccactctgcggaagaacatatgatatctcttatgattataaaaactctcaaatgtatatcgtcgatggacattatcatctctgcgtcgtcggaaaagaaggaggatatgcaacacaactcgcaacatctgtccaaggagtcccattcaaatggctctatgcagtcacagtcgatcaaagaacaggaatcgtctatttcacagatgtctcttctatccatgatgattctccagaaggagtcgaagaaatcatgaacacatctgatagaacaggaagactcatgaaatatgatccatctacaaaagaaacaacactcctcctcaaagaactccatgtcccaggaggagcagaaatctctgcagatggatctttcgtcgtcgtcgcagaattcctctctaacagaatcgtcaaatattggctcgaaggaccaaaaaaaggatctgcagaattcctcgtcacaatcccaaacccaggaaacatcaaaagaaactctgatggacatttctgggtctcttcttctgaagaactcgatggaggacaacatggaagagtcgtctctagaggaatcaaattcgatggattcggaaacatcctccaagtcatcccactcccaccaccatatgaaggagaacatttcgaacaaatccaagaacatgatggactcctctatatcggatctctcttccattcttctgtcggaatcctcgtctatgatgatcatgataacaaaggaaactcttatgtctcttcttga

SEQ ID NO: 505 - DNA, 1108 bp, synthetic construct
  source 1..1108: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgaaaggaggattcacaggaggagatgaatatcaaaaacatttcctcccaagagattatctcgcaacatattattctttcgatggatctccatctccagaagcagaaatgctcaaattcaacctcgaatgcctccataaaacattcggaccaggaggactccaaggagatacactcatcgatatcggatctggaccaacaatctatcaagtcctcgcagcattcgattctttccaagatatcacactctctgatttcacagatagaaacagagaagaactcgaaaaatggctcaaaaaagaaccaggagcatatgattggacaccagcagtcaaattcgcatgcgaactcgaaggaaactctggaagatgggaagaaaaagaagaaaaactcagagcagcagtcaaaagagtcctcaaatgcgatgtccatctcggaaacccactcgcaccagcagtcctcccactcgcagattgcgtcctcacactcctcgcaatggaatgcgcatgctgctctctcgatgcatatagagcagcactctgcaacctcgcatctctcctcaaaccaggaggacatctcgtcacaacagtcacactcagactcccatcttatatggtcggaaaaagagaattctcttgcgtcgcactcgaaaaagaagaagtcgaacaagcagtcctcgatgcaggattcgatatcgaacaactcctccattctccacaatcttattctgtcacaaacgcagcaaacaacggagtctgcttcatcgtcgcaagaaaaaaaccaggaccatga

SEQ ID NO: 506 - DNA, 1261 bp, synthetic construct
  source 1..1261: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgagacaaatcgaaatcgaatgggtccaaccaggaatcacagtcacagcagatctctcttgggaaagaaacccagaactcgcagaactcctctggacaggactcctcccatataactctctccaaaaccatgcactcgtctctggaaaccatctctatcatctcatcgcagatccaagactcgtctatacagaagcaagatataaagaagatagaacaaaatctccagatggaacagtcttcctctctcaactccaacatctcgcagtcaaatatggaccactcacagaatatctcccagcagcaccagtcggatctgtcgtcccagaagatatcgatgcactcagagaagcaggaagagcatgctggaaagcagcatgggaaacaaaacaaccaatcgaagtcagagtcagaagaaaaggagaagcagtcacagatttcgcactcccaagaacaccaccagtcgatcatccaggagtccaaaaactcgtcgaagaaatccaagatgaaacagaaagagtctggatcacaccaccagcagaaatcgtcgatatgcatcaaggaagaatcgcatctagagcaggatcttatgatcaatatttctctacactcgtcttcctcaacggagaagtcagaccactcggatattgcgcactcaacggactcctcaaaatctgcagaacaacagatctcacactcaacgatctcaaaagaatcacaccaacattcatcaaaacaccagcagaattcctcggatatacaggactcgatacactctggagattcacacaacaagtcctcacactcctcccagatgtcgaaacaagagaacaatatttcgcactcgtcaacgcactcgcactctatgcaaacatgctcaacacatggaacctccatttcttcccatggcaacatggaacagattatagatatctcgatgcatga

SEQ ID NO: 507 - DNA, 4296 bp, synthetic construct
  source 1..4296: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcaaacagacgctgtggatcaagcaacgccactcgctcgctccatcgcaggctggtcgcagacaaattaaaaggcggcaaactcgtacagccgcggggttgtccgctgcaaagtacagagtgataaaagccgccatgcgaccatcaacgcgttgatgcccagctttttcgatccgagaatccaccgtagaggcgatagcaagtaaagaaaagctaaacaaaaaaaaatttctgcccctaagccatgaaaacgagatggggtggagcagaaccaaggaaagagtcgcgctgggctgccgttccggaaggtgttgtaaaggctcgacgcccaaggtgggagtctaggagaagaatttgcatcgggagtggggcgggttacccctccatatccaatgacagatatctaccagccaagggtttgagcccgcccgcttagtcgtcgtcctcgcttgcccctccataaaaggatttcccctccccctcccacaaaattttctttcccttcctctccttgtccgcttcagtacgtatatcttcccttccctcgcttctctcctccatccttctttcatccatctcctgctaacttctctgctcagcacctctacgcattactagccgtagtatctgagcacttctcccttttatattccacaaaacataacacaaccttcaccgggtcttcgccggatccagtgctaacatggtctagaaggaggtcagctatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccagtggtgcatatcggggatgaaagctggcgcatgatgaccaccgatatggccagtgtgccagtctccgttatcggggaagaagtggctgatctcagccaccgcgaaaatgacatcaaaaacgccattaacctgatgttctggggaatataactgcagaggaggtaatcaagaagacctgttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactgagaaacaggtcggaagccaatggccaggagctccttgtaaaaaaatactccttggtctattaagttgcccattctttagcaggagtgtgcagactatgtccgtatccacatgccgcaactgcagattcataggagctgttggggatattggcataggatcccattgttacgtactatttaatgacaaatacacgatcaatttcaccactattgttcacttctactggtagcttagacgtactatttctcgtggaatagccagtacttgctcttatattggccgtcgcgaatttcggcgtcgacaacgagctaccacatttgttcatgccaggcaatgccacaacactggtggtaccggcttgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 508 - DNA, 7989 bp, synthetic construct
  source 1..7989: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcatcagagcttattttttgtatactgttttgtgatagcacgaagtttttccacggtatcttgttaaaaatatatatttgtggcgggcttacctacatcaaattaataagagactaattataaactaaacacacaagcaagctactttagggtaaaagtttataaatgcttttgacgtataaacgttgcttgtatttattattacaattaaaggtggatagaaaacctagagactagttagaaactaatctcaggtttgcgttaaactaaatcagagcccgagaggttaacagaacctagaaggggactagatatccgggtagggaaacaaaaaaaaaaancaagacagccacatattagggagactagttagaagctagttccaggactaggaaaataaaagacaatgataccacagtctagttgacaactagatagattctagattgaggccaaagtctctgagatccaggttagttgcaactaatactagttagtatctagtctcctataactctgaagctagaataacttactactattatcctcaccactgttcagctgcgcaaacggagtgattgcaaggtgttcagagactagttattgactagtcagtgactagcaataactaacaaggtattaacctaccatgtctgccatcaccctgcacttcctcgggctcagcagccttttcctcctcattttcatgctcattttccttgtttaagactgtgactagtcaaagactagtccagaaccacaaaggagaaatgtcttaccactttcttcattgcttgtctcttttgcattatccatgtctgcaactagttagagtctagttagtgactagtccgacgaggacttgcttgtctccggattgttggaggaactctccagggcctcaagatccacaacagagccttctagaagactggtcaataactagttggtctttgtctgagtctgacttacgaggttgcatactcgctccctttgcctcgtcaatcgatgagaaaaagcgccaaaactcgcaatatggctttgaaccacacggtgctgagactagttagaatctagtcccaaactagcttggatagcttacctttgccctttgcgttgcgacaggtcttgcagggtatggttcctttctcaccagctgatttagctgccttgctaccctcacggcggatctgcataaagagtggctagaggttataaattagcactgatcctaggtacggggctgaatgtaacttgccyttcctttctcatcgcgcggcaagacaggcttgctcaaattcctaccagtcacaggggtatgcacggcgtacggaccacttgaactagtcacagattagttagcaactagtctgcattgaatggctgtacttacgggccctcgccattgtcctgatcatttccagcttcaccctcgttgctgcaaagtagttagtgactagtcaaggactagttgaaatgggagaagaaactcacgaattctcgacacccttagtattgtggtccttggacttggtgctgctatatattagctaatacactagttagactcacagaaacttacgcagctcgcttgcgcttcttggtaggagtcggggttgggagaacagtgccttcaaacaagccttcataccatgctacttgactagtcagggactagtcaccaagtaatctagataggacttgcctttggcctccatcagttccttcatagtgggaggtccattgtgcaatgtaaactccatgccgtgggagttcttrtccttcaagtgcttgaccaatatgtttctgttggcagagggaacctgtcaactagttaataactagtcagaaactagtatagcagtagactcactgtacgcttgaggcatcccttcactcggcagtagacttcatatggatggatatcaggcacgccattgtcgtcctgtggactagtcagtaactaggcttaaagctagtcgggtcggcttactatcttgaaatccggcagcgtaagctccccgtccttaactgcctcgagatagtgacagtactctggggactttcggagatcgttatcgcgaatgctcggcatactaatcgttgactagtcttggactagtcccgagcaaaaaggattggaggaggaggaggaaggtgagagtgagacaaagagcgaaataagagcttcaaaggctatctctaagcagtatgaaggttaagtatctagttcttgactagatttaaaagagatttcgactagttatgtacctggagtttggatataggaatgtgttgtggtaacgaaatgtaagggggaggaaagaaaaagtcggtcaagaggtaactctaagtcggccattcctttttgggaggcgctaaccataaacggcatggtcgacttagagttagctcagggaatttagggagttatctgcgaccaccgaggaacggcggaatgccaaagaatcccgatggagctctagctggcggttgacaaccccaccttttggcgtttctgcggcgttgcaggcgggactggatacttcgtagaaccagaaaggcaaggcagaacgcgctcagcaagagtgttggaagtgatagcatgatgtgccttgttaactaggtcaaaatctgcagtatgcttgatgttatccaaagtgtgagagaggaaggtccaaacatacacgattgggagagggcctaggtataagagtttttgagtagaacgcatgtgagcccagccatctcgaggagattaaacacgggccggcatttgatggctatgttagtaccccaatggaaacggtgagagtccagtggtcgcagataactccctaaattccctgagctaactctaagtcgaccatgccgtttatggttagcgcctcccaaaaaggaatggccgacttagagttacctcttgaccgactttttctttcctcccccttacatttcgttaccacaacacattcctatatccaaactccaggtacataactagtcgaaatctcttttaaatctagtcaagaactagatacttaaccttcatactgcttagagatagcctttgaagctcttatttcgctctttgtctcactctcaccttcctcctcctcctccaatcctttttgctcgggactagtccaagactagtcaacgattagtatgccgagcattcgcgataacgatctccgaaagtccccagagtactgtcactatctcgaggcagttaaggacggggagcttacgctgccggatttcaagatagtaagccgacccgactagctttaagcctagttactgactagtccacaggacgacaatggcgtgcctgatatccatccatatgaagtctactgccgagtgaagggatgcctcaagcgtacagtgagtctactgctatactagtttctgactagttattaactagttgacaggttccctctgccaacagaaacatattggtcaagcacttgaaggayaagaactcccacggcatggagtttacattgcacaatggacctcccactatgaaggaactgatggaggccaaaggcaagtcctatctagattacttggtgactagtccctgactagtcaagtagcatggtatgaaggcttgtttgaaggcactgttctcccaaccccgactcctaccaagaagcgcaagcgagctgcgtaagtttctgtgagtctaactagtgtattagctaatatatagcagcaccaagtccaaggaccacaatactaagggtgtcgagaattcgtgagtttcttctcccatttcaactagtccttgactagtcactaactactttgcagcaacgagggtgaagctggaaatgatcaggacaatggcgagggcccgtaagtacagccattcaatgcagactagttgctaactaatctgtgactagttcaagtggtccgtacgccgtgcatacccctgtgactggtaggaatttgagcaagcctgtcttgccgcgcgatgagaaaggaarggcaagttacattcagccccgtacctaggatcagtgctaatttataacctctagccactctttatgcagatccgccgtgagggtagcaaggcagctaaatcagctggtgagaaaggaaccataccctgcaagacctgtcgcaacgcaaagggcaaaggtaagctatccaagctagtttgggactagattctaactagtctcagcaccgtgtggttcaaagccatattgcgagttttggcgctttttctcatcgattgacgaggcaaagggagcgagtatgcaacctcgtaagtcagactcagacaaagaccaactagttattgaccagtcttctagaaggctctgttgtggatcttgaggccctggagagttcctccaacaatccggagacaagcaagtcctcgtcggactagtcactaactagactctaactagttgcagacatggataatgcaaaagagacaagcaatgaagaaagtggtaagacatttctcctttgtggttctggactagtctttgactagtcacagtcttaaacaaggaaaatgagcatgaaaatgaggaggaaaaggctgctgagcccgaggaagtgcagggtgatggcagacatggtaggttaataccttgttagttattgctagtcactgactagtcaataactagtctctgaacaccttgcaatcactccgtttgcgcagctgaacagtggtgaggataatagtagtaagttattctagcttcagagttataggagactagatactaactagtattagttgcaactaacctggatctcagagactttggcctcaatctagaatctatctagttgtcaactagactgtggtatcattgtcttttattttcctagtcctggaactagcttctaactagtctccctaatatgtggctgtcttgttttttttttttgtttccctacccggatatctagtccccttctaggttctgttaacctctcgggctctgatttagtttaacgcaaacctgagattagtttctaactagtctctaggttttctatccacctttaattgtaataataaatacaagcaacgtttatacgtcaaaagcatttataaacttttaccctaaagtagcttgcttgtgtgtttagtttataattagtctcttattaatttgatgtaggtaagcccgccacaaatatatatttttaacaagataccgtggaaaaacttcgtgctatcacaaaacagtatacaaaaaataagctctgctgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 509 - DNA, 1807 bp, synthetic construct
  source 1..1807: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccatggtttgtctctcgcttgcataccacccagcagctcactgatgtcgacttgtaggttaaagcacctctcaccaccatgatccccatagtactctcgctcctcatagcaggatgcatatactacatcaacgctcgcaggataaagcgttcccgcttaccccctggaccgcctggcatacctatcccattcattgggaatatgtttgatatgccttcagagtctccatggttgatctttttacaatggggacaggaatatcaaaccgacatcatctacgtcgatgctggaggaacggacatgattattctgaactcattggaggctataaccgacttgttggaaaagcgggggtccctgtactccggtcgactcgagagcacgatggtgaacgagctcatgggatgggagttcgattttggattcataccctacggcgagagatggcgcgaagaaaggcgcatgttcgccaaggagttcagcgagaaaaatataaggcaattccgccacgctcaagtgaaggctgccaatcagcttgtccggcagctgacagacaagccagatcgttggtcacaccacatccggcatcagatagcgtctatggctctggatattggctatgggatcgatctggccgaggatgatccctggattgcagcatctgagctagcaaacgaagggctcgctgttgcatcagtgccgggcagtttctgggtcgacacattccctttccttaaataccttccgtcctggcttccaggtgctgaattcaagcgcaatgcaaagatgtggaaggaaggcgctgaccatatggtgaatatgccatatgaaacaatgaaaaaactgtctgctcaaggtttgacccgaccctcatacgcctcggctcgcctccaggctatggatcctaatggcgatctcgagcaccaggaacgtgtgatcaagaatacggccacacaagtcaatgtcggtggcggtgatacgactgtcggtgctgtgtcagcatttattttagctatggtcaaatatcccgaggttcaacgtaaagtccaagctgagctggatgaattcacgagtaaaggccgtatcccagattacgacgaagataacgactccttgccgtatctcagcgcatgctttaaggaactctttcgatggggccagattgcaccccttgctattgctcatcgacttatcaaggatgatgtttaccgcgagtatactatacctaagaatgctttggtcttcgctaataattggtacggacggactgtactgaacgatccctctgagtatccaaatccctctgagttccgtccagaacgatatctcggtcctgacgggaagcccgacgatacggttcgtgatccccgcaaagcagcattcgggtatggtcgtcgcgtttgccctggaatccaccttgctcagtcgacggtatggattgcaggggtggctcttgtgtccgcgttcaacatcgaactgcctgttgataaggatgggaaatgtattgacataccagcggcgtttacaacaggatttttcaggtaa

SEQ ID NO: 510 - DNA, 1813 bp, synthetic construct
  source 1..1813: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccatggtttgtctctcgcttgcataccacccagcagctcactgatgtcgacttgtaggttaaacaaaacggcgcactcactgtatttgttgcatttatttctgcagcgtgcatatactatgtgcacgctcgtcgggctcggcgagcctcgctgccaccaggtccgcgcggaatacccctgccatttgtggggaatgtattcgatatgccttcggagtcttcttggctcacgttcctggaatggggaaaacagtatcaatctgatttgatctacttaaactccgggggaatagaaatggtcattctgaacacgttggaaacaatgaccgatctcttggagaagaggggatctatatattcaggacgactagaaagtacaatggtcaatgaactcatgggttggaaattcgattttggattcgtgacctatggcgagcgctggcgagaagaaagacgcatgttttcgagggagttcaacgagaaaaatatcaaacaatttcgtcatgcacaagtcaaggccctcaaagaactcgttcggaaacttgacaaagacccaagtcgatggtaccagcatcttcgacaccaaattgcatctatggccttggatattggctatggaattgatctcgcagaaaacgacccatggattgaagagaccatcctcgcaaacgatgctctagcccttgcatctgtccctgggtgctattgggttgactcgtttcccattcttcaatatgttccatcttggcttccctttgcaggattcaagcgcaaagcaaaggtgtggaagaaaaataccgagtacatggtcaacgttctatacgagaccatgaaaagacagacagtacaagggttaacccgtccatcctatgcttcagcacgtttacaggccatggctccagacattaaccttgaacatcaagaacgggtaattaaaaattcagcctcacaggttattgttggcggtggcgatactaccgtgtctgcattggcagcatttattctagctatggtcaaatatcctaatgtccaacgcaaggtccaggcggagctcgacgcgatcgcgagccaaaacgaaatacccgactttgacgaagaaaatggaacgatgccatacctcaccgcatgtctcaaagaagttttccgctggaaccagatcgcgccccttggtatcgcccaccggcttgacaaggacgattcttaccgtggctacctcatacccaagggaaccttggtttttgccaacatttgggctatcttgaacgatccattgatgtatcctaatcctggcgagtttcaacctgagcgatatctcggacctgacggcaagcacgatccctctgtgcgcgacccacgtaaaattgccttcggctggggtcgacgcgcttgtcccggcatatacttggcacaatccaccgtatggcacacagcaacgaacctcctctctgcattcaacatagagccacctcttaacgaagagggaaagcctatcaaagtcgaggcggctttcaccactggatttttcaggtatagtccccgcagtgatgcatga

SEQ ID NO: 511 - DNA, 1399 bp, synthetic construct
  source 1..1399: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccatggtttgtctctcgcttgcataccacccagcagctcactgatgtcgacttgtaggttaaagcacccgcaacacccgcaactcacgatcctgccttgtcccacggagcccctcctgctccaggtgctccagctcctgcaaatgctcctccaaacgcctcaggagacattgctggaatgcagctcagcggactcgatcagtcccagatcatgaaccttcttcgttcattgcctggcatgttctcgggcggtaaaatacccgaccaaggccaaggcaacaaagaggatgctgctcaaacgctgtccaaccttgcccaagctcaaccgtatggacaacaattaccccttcactaccaagctggcggcccaggaggtctgccaggaattaacgacccaggcccgtccacacatccccgcggccctcccaaccttggccaactgagtgctgtggcaatgcaagccgcccccgctccaattcagcatccagaccagcaaacgaaccgcaacgatggcgagcaggctggcaatgcgagtgcaagtacctccggaaaggatggtgacaatgcagaattcgttcccccacctgctcctgctcctacaactggtcgccgtggtggacgcagcgccaccatgggaagtgacgaatggagcagacagaggaaggataatcataaagaggttgagcgtcgacgccgcggcaatatcaacgagggcatcaacgagcttggccgcattgtacccagtgggtctggcgagaaggccaaaggcgccatcctttctcgagctgtgcagtacatccatcatttgaaagagaacgaagctcgcaatatcgagaagtggacccttgagaagcttctcatggaccaggccatgggtgacctgcaggcgcaactcgaagaggtcaagcgtctgtgggaagaagagcgtatggcgcgcacaagactcgaggccgagctcgaagtgttgagaaatatgaacggcgtgaatgctggctcggccccggcctcgaaagatgagagtgctgcaggtactaagaggaggagtaccgatggagcagaggccgccaccgccgccactgaaagcagcaccgccaatgccgagggcgaacgcgacggcaagcgacaaagaaccgagtga

SEQ ID NO: 512-600 - skipped (89 entries)

SEQ ID NO: 601 - DNA, 11431 bp, synthetic construct
  source 1..11431: mol_type = other DNA
cagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcgatccccatccaacagcccgccgtcgagcgggcttttttatccccggaagcctgtggatagagggtagttatccacgtgaaaccgctaatgccccgcaaagccttgattcacggggctttccggcccgctccaaaaactatccacgtgaaatcgctaatcagggtacgtgaaatcgctaatcggagtacgtgaaatcgctaataaggtcacgtgaaatcgctaatcaaaaaggcacgtgagaacgctaatagccctttcagatcaacagcttgcaaacacccctcgctccggcaagtagttacagcaagtagtatgttcaattagcttttcaattatgaatatatatatcaattattggtcgcccttggcttgtggacaatgcgctacgcgcaccggctccgcccgtggacaaccgcaagcggttgcccaccgtcgagcgcctttgcccacaacccggcggccggccgcaacagatcgttttataaatttttttttttgaaaaagaaaaagcccgaaaggcggcaacctctcgggcttctggatttccgatccccggaattagatcttggcaggatatattgtggtgtaacgttggatctggctgagaacgccagctgtgcatgcttggtctagaatacgatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcatagtgatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctacttcagacttttctttttttttttggtgctgctgggactccatggattccatctcctcccaattgtgacaaatcgattcttgtttcatacaatcctgtgattgattgatggatcaatgttgcatccaagacttcttttgttgatgtatatctttttctatcgattgttgtatcgaaatatttgaatgctgctggtgctcccaagtttgtcaatgtgaacaaatggatgatgttttctgcttgttctctgattggtttatctctatgtttgttatatgctgacaagactttatccaagtttgcatctgccaagatgactctttttgagaattctgagatttgttcgatgatttcatccaaataatgtttatgttgttcgacgaacaattgtttttgttcgttatcttctggtgatcctttcaatttttcataatgtgatgccaaatacaagaagttgacatattttgatggcaatgccaattcgtttcctttttgcaattctcctgctgatgccaacattctttttcttccgttttccaattcgaacaatgaatattttggcaatttgatgatcaaatcttttttgacttctttatatccttttgcttccaagaaatcgattgggtttttttcgaatgatgatctttccatgattgtgattcccaacaattctttgactgatttcaatttttttgattttcctttttcgacttttgcgacgaccaagactgaatatgcgactgttggtgaatcgaatcctccatatttttttggatcccaatctttttttcttgcgatcaatttatctgagtttctttttggcaagattgattcttttgagaatcctcctgtttggacttctgtttttttgacgatgttgacttgtggcattgacaagacttttctgactgttgcgaaatctcttcctttatcccagacgatttctcctgtttctccgtttgtttcgatcaatggtctttttctgatttctccgtttgccaatgtgatttctgttttgaagaagttcatgatgtttgaatagaagaaatattttgctgttgcttttccgatttcttgttctgattttgcgatcatttttctgacatcatagactttataatctccatagacgaattctgattccaattttggatattttttgatcaatgctgttccgacgactgcgttcaaatatgcatcatgtgcatgatgatagttgttgatttctctgactttatagaattggaaatcttttctgaaatctgaaaccaattttgatttcaatgtgatgactttgacttctctgatcaatttatcgttttcatcatattttgtgttcattcttgaatccaagatttgtgcgacatgttttgtgatttgtcttgtttcgaccaattgtcttttgatgaatcctgctttatccaattctgacaatcctcctctttctgcttttgtcaagttatcgaattttctttgtgtgatcaattttgcgttcaacaattgtctccaatagtttttcatttttttgacgacttcttctgatgggacgttatctgattttcctctgtttttatctgatcttgtcaagactttgttatcgattgaatcatctttcaagaatgattgtgggacgatatgatcgacatcataatctgacaatctgttgatatccaattcttgatcgacatacatatctcttccgttttgcaaataatacaaatacaatttttcgttttgcaattgtgtgttttcgactggatgttctttcaagatttgtgatcccaattctttgattccttcttcgattcttttcattctttctcttgagtttttttgtcctttttgtgttgtttggttttctcttgccatttcgatgacgatgttttctggtttatgtcttcccatgactttgaccaattcatcgacgactttgactgtttgcaagattccttttttgattgctggtgatcctgccaagtttgcgatatgttcatgcaatgaatctccttgtcctgagacttgtgctttttggatatcttctttgaatgtcaatgaatcatcatggatcaattgcatgaagtttctgtttgcgaatccatctgatttcaagaaatccaagattgtttttcctgattgtttatctctgattccgttgatcaattttcttgacaatcttccccatcctgtatatcttcttcttttcaattgtttcatgactttatcatcgaacaaatgtgcatatgttttcaatctttcttcgatcatttctctatcttcgaacaatgtcaatgtcaagacgatatcttccaagatatcttcgttttcttcgttatccaagaaatctttatctttgatgattttcaacaaatcatgatatgttcccaatgatgcgttgaatctatcttcgactcctgagatttcgactgaatcgaagcattcgatttttttgaaataatcttctttcaattgtttgactgtgacttttctgtttgttttgaacaacaaatcgacgattgcttttttttgttctcctgacaagaatgctggttttctcattccttctgtgacatatttgacttttgtcaattcgttatagactgtgaaatattcatacaacaatgaatgttttggcaagactttttcgtttggcaagtttttatcgaagtttgtcattctttcgatgaatgattgtgctgatgctcctttatcgacgacttcttcgaagttccatggtgtgattgtttcttctgattttcttgtcatccatgcgaatcttgagtttcctcttgccaatggtccgacataatatgggattctgaatgtcaagattttttcgattttttctctgttatctttcaagaatggatagaaatcttcttgtcttctcaagattgcatgcaattctcccaaatggatttgatgtgggattgatccgttatcgaatgttctttgttttctcaacaaatcttctctgttcaatttgaccaacaattcttctgttccatccattttttccaagattggtttgatgaatttatagaattcttcttgtgatgctcctccatcgatatatcctgcatatccgttttttgattgatcgaagaagatttctttatatttttctggcaattgttgtctgaccaatgctttcaacaatgtcaaatcttgatgatgttcatcatatcttttgatcattgatgctgacaatggtgcttttgtgatttctgtgttgactctcaagatatctgacaacaagattgcatctgacaagttttttgctgccaagaacaaatctgcatattgatctccgatttgtgccaacaagttatccaaatcatcatcatatgtatcttttgacaattgcaattttgcatcttctgccaaatcgaagtttgatttgaagtttggtgtcaatcccaatgacaatgcgatcaagtttccgaacaatccgttttttttttctcctggcaattgtgcgatcaagttttccaatcttcttgattttgacaatcttgctgacaagattgcttttgcatcgactcctgatgcgttgattgggttttcttcgaacaattggttatatgtttggaccaattggatgaacaatttatcgacatctgagttatctgggttcaaatctccttcgatcaagaaatgtcctctgaatttgatcatatgtgccaatgccaaatagatcaatctcaaatctgctttatctgttgaatcgaccaatttttttctcaaatgatagattgttggatatttttcatgatatgcgacttcatcgacgatgtttccgaagattggatgtctttcatgttttttatcttcttcgaccaagaatgattcttccaatctatggaagaatgaatcatcgacttttgccatttcgtttgagaagatttcttgcaaatagcagattctgttttttcttcttgtatatcttcttcttgctgttcttttcaatcttgttgcttctgctgtttctcctgaatcgaacaacaatgctccgatcaagttttttttgattgaatgtctatctgtgtttcccaagactttgaatttttttgatgggactttatattcatctgtgatgactgcccatccgactgagtttgttccgatatccaatccgattgaatattttttatctgctgctgggactccatggattccgacttttctttttttttttggtgctgctttatcatcatcatctttataatcgatatcatgatctttataatctccatcatgatctttataatctttaacctacaagtcgacatcagtgagctgctgggtggtatgcaagcgagagacaaaccatggtaccggcgatgagcttgttgtgtgtagatgggagaaaacggagatggtggatgtgaccggaattggggtttttgtactatcgatgtcatcacaaattattatcatatcagattgctaacccctaaacaccgagaacattcgagacgcgggaacagcagctctagatcctcaacgcttataaactgctagcctgacacagaatgacgcaagcctcgaaaatgctctattgttaaaaacgtactgaactttcaatctacttgcggacctcttaattcttcttcgctacatacacaacctcatcgcagactctacgcgcatatccccactcattatcataccatgcaactaatttcataaaacgcgagttcaacgcgatgcccgcttttgcgtcaaagatcatcgaatagttgctcccaacgaaatcggtggaaacaacgtcttcttccgtatagtcgacaatgcctttctcgatgcccgggtgtttaccgtcggctgcgtctttcagagctcgcagggtaccaccagtgttgtggcataaaaaagcaccgactcggtgccactttttcaagttgataacggactagccttattttaacttgctatttctagctctaaaacccgaaggtaaatcgcgagtccaatagtgtatggcagtgggatgttgacatagcaagggttttgctttttgcttagctcacggggtgagacttcttaccaaatatagaaatcagcgaggttgcccatatcctacgcttgttctacgctggcaattaatgcccgtaccatgctttcctccagcgtgagagagtcgtcgtcaaaagattggccacagctataggtgctaatattaatgagtaaaatgtaaaacaaaaattgtaccttgctgttgcagatgtcagattcaataatgcagtggctggtgctggtactgctggtaccctgaggtaccaccagtgttgtggcataaaaaagcaccgactcggtgccactttttcaagttgataacggactagccttattttaacttgctatttctagctctaaaacccatggtgcgcgttaccccacaatagtgtatggcagtgggatgttgacatagcaagggttttgctttttgcttagctcacggggtgagacttcttaccaaatatagaaatcagcgaggttgcccatatcctacgcttgttctacgctggcaattaatgcccgtaccatgctttcctccagcgtgagagagtcgtcgtcaaaagattggccacagctataggtgctaatattaatgagtaaaatgtaaaacaaaaattgtaccttgctgttgcagatgtcagattcaataatgcagtggctggtgctggtactgctggtaccagccggtaccaccagtgttgtggcataaaaaagcaccgactcggtgccactttttcaagttgataacggactagccttattttaacttgctatttctagctctaaaacttgcggtataaccggagatgcattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcatgttggtaccaccagtgttgtggcataaaaaagcaccgactcggtgccactttttcaagttgataacggactagccttattttaacttgctatttctagctctaaaactcatggagccagatatccaacattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcaaggtggtacctggtgcgatcgctgttggcgcgccgtgtttaattaaggttgcggccgcttacttcgtccgagcctagttcgagccttgacaggatatattggcgggtaaactaagtcgctgtatgtgtttgtttgagatctcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaagaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgtgtaacattggtctagtgattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattg

SEQ ID NO: 602 - DNA, 11431 bp, synthetic construct
  source 1..11431: mol_type = other DNA
cagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcgatccccatccaacagcccgccgtcgagcgggcttttttatccccggaagcctgtggatagagggtagttatccacgtgaaaccgctaatgccccgcaaagccttgattcacggggctttccggcccgctccaaaaactatccacgtgaaatcgctaatcagggtacgtgaaatcgctaatcggagtacgtgaaatcgctaataaggtcacgtgaaatcgctaatcaaaaaggcacgtgagaacgctaatagccctttcagatcaacagcttgcaaacacccctcgctccggcaagtagttacagcaagtagtatgttcaattagcttttcaattatgaatatatatatcaattattggtcgcccttggcttgtggacaatgcgctacgcgcaccggctccgcccgtggacaaccgcaagcggttgcccaccgtcgagcgcctttgcccacaacccggcggccggccgcaacagatcgttttataaatttttttttttgaaaaagaaaaagcccgaaaggcggcaacctctcgggcttctggatttccgatccccggaattagatcttggcaggatatattgtggtgtaacgttggatctggctgagaacgccagctgtgcatgcttggtctagaatacgatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcatagtgatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctacttcagacttttctttttttttttggtgctgctgggactccatggattccatctcctcccaattgtgacaaatcgattcttgtttcatacaatcctgtgattgattgatggatcaatgttgcatccaagacttcttttgttgatgtatatctttttctatcgattgttgtatcgaaatatttgaatgctgctggtgctcccaagtttgtcaatgtgaacaaatggatgatgttttctgcttgttctctgattggtttatctctatgtttgttatatgctgacaagactttatccaagtttgcatctgccaagatgactctttttgagaattctgagatttgttcgatgatttcatccaaataatgtttatgttgttcgacgaacaattgtttttgttcgttatcttctggtgatcctttcaatttttcataatgtgatgccaaatacaagaagttgacatattttgatggcaatgccaattcgtttcctttttgcaattctcctgctgatgccaacattctttttcttccgttttccaattcgaacaatgaatattttggcaatttgatgatcaaatcttttttgacttctttatatccttttgcttccaagaaatcgattgggtttttttcgaatgatgatctttccatgattgtgattcccaacaattctttgactgatttcaatttttttgattttcctttttcgacttttgcgacgaccaagactgaatatgcgactgttggtgaatcgaatcctccatatttttttggatcccaatctttttttcttgcgatcaatttatctgagtttctttttggcaagattgattcttttgagaatcctcctgtttggacttctgtttttttgacgatgttgacttgtggcattgacaagacttttctgactgttgcgaaatctcttcctttatcccagacgatttctcctgtttctccgtttgtttcgatcaatggtctttttctgatttctccgtttgccaatgtgatttctgttttgaagaagttcatgatgtttgaatagaagaaatattttgctgttgcttttccgatttcttgttctgattttgcgatcatttttctgacatcatagactttataatctccatagacgaattctgattccaattttggatattttttgatcaatgctgttccgacgactgcgttcaaatatgcatcatgtgcatgatgatagttgttgatttctctgactttatagaattggaaatcttttctgaaatctgaaaccaattttgatttcaatgtgatgactttgacttctctgatcaatttatcgttttcatcatattttgtgttcattcttgaatccaagatttgtgcgacatgttttgtgatttgtcttgtttcgaccaattgtcttttgatgaatcctgctttatccaattctgacaatcctcctctttctgcttttgtcaagttatcgaattttctttgtgtgatcaattttgcgttcaacaattgtctccaatagtttttcatttttttgacgacttcttctgatgggacgttatctgattttcctctgtttttatctgatcttgtcaagactttgttatcgattgaatcatctttcaagaatgattgtgggacgatatgatcgacatcataatctgacaatctgttgatatccaattcttgatcgacatacatatctcttccgttttgcaaataatacaaatacaatttttcgttttgcaattgtgtgttttcgactggatgttctttcaagatttgtgatcccaattctttgattccttcttcgattcttttcattctttctcttgagtttttttgtcctttttgtgttgtttggttttctcttgccatttcgatgacgatgttttctggtttatgtcttcccatgactttgaccaattcatcgacgactttgactgtttgcaagattccttttttgattgctggtgatcctgccaagtttgcgatatgttcatgcaatgaatctccttgtcctgagacttgtgctttttggatatcttctttgaatgtcaatgaatcatcatggatcaattgcatgaagtttctgtttgcgaatccatctgatttcaagaaatccaagattgtttttcctgattgtttatctctgattccgttgatcaattttcttgacaatcttccccatcctgtatatcttcttcttttcaattgtttcatgactttatcatcgaacaaatgtgcatatgttttcaatctttcttcgatcatttctctatcttcgaacaatgtcaatgtcaagacgatatcttccaagatatcttcgttttcttcgttatccaagaaatctttatctttgatgattttcaacaaatcatgatatgttcccaatgatgcgttgaatctatcttcgactcctgagatttcgactgaatcgaagcattcgatttttttgaaataatcttctttcaattgtttgactgtgacttttctgtttgttttgaacaacaaatcgacgattgcttttttttgttctcctgacaagaatgctggttttctcattccttctgtgacatatttgacttttgtcaattcgttatagactgtgaaatattcatacaacaatgaatgttttggcaagactttttcgtttggcaagtttttatcgaagtttgtcattctttcgatgaatgattgtgctgatgctcctttatcgacgacttcttcgaagttccatggtgtgattgtttcttctgattttcttgtcatccatgcgaatcttgagtttcctcttgccaatggtccgacataatatgggattctgaatgtcaagattttttcgattttttctctgttatctttcaagaatggatagaaatcttcttgtcttctcaagattgcatgcaattctcccaaatggatttgatgtgggattgatccgttatcgaatgttctttgttttctcaacaaatcttctctgttcaatttgaccaacaattcttctgttccatccattttttccaagattggtttgatgaatttatagaattcttcttgtgatgctcctccatcgatatatcctgcatatccgttttttgattgatcgaagaagatttctttatatttttctggcaattgttgtctgaccaatgctttcaacaatgtcaaatcttgatgatgttcatcatatcttttgatcattgatgctgacaatggtgcttttgtgatttctgtgttgactctcaagatatctgacaacaagattgcatctgacaagttttttgctgccaagaacaaatctgcatattgatctccgatttgtgccaacaagttatccaaatcatcatcatatgtatcttttgacaattgcaattttgcatcttctgccaaatcgaagtttgatttgaagtttggtgtcaatcccaatgacaatgcgatcaagtttccgaacaatccgttttttttttctcctggcaattgtgcgatcaagttttccaatcttcttgattttgacaatcttgctgacaagattgcttttgcatcgactcctgatgcgttgattgggttttcttcgaacaattggttatatgtttggaccaattggatgaacaatttatcgacatctgagttatctgggttcaaatctccttcgatcaagaaatgtcctctgaatttgatcatatgtgccaatgccaaatagatcaatctcaaatctgctttatctgttgaatcgaccaatttttttctcaaatgatagattgttggatatttttcatgatatgcgacttcatcgacgatgtttccgaagattggatgtctttcatgttttttatcttcttcgaccaagaatgattcttccaatctatggaagaatgaatcatcgacttttgccatttcgtttgagaagatttcttgcaaatagcagattctgttttttcttcttgtatatcttcttcttgctgttcttttcaatcttgttgcttctgctgtttctcctgaatcgaacaacaatgctccgatcaagttttttttgattgaatgtctatctgtgtttcccaagactttgaatttttttgatgggactttatattcatctgtgatgactgcccatccgactgagtttgttccgatatccaatccgattgaatattttttatctgctgctgggactccatggattccgacttttctttttttttttggtgctgctttatcatcatcatctttataatcgatatcatgatctttataatctccatcatgatctttataatctttaacctacaagtcgacatcagtgagctgctgggtggtatgcaagcgagagacaaaccatggtaccggcgatgagcttgttgtgtgtagatgggagaaaacggagatggtggatgtgaccggaattggggtttttgtactatcgatgtcatcacaaattattatcatatcagattgctaacccctaaacaccgagaacattcgagacgcgggaacagcagctctagatcctcaacgcttataaactgctagcctgacacagaatgacgcaagcctcgaaaatgctctattgttaaaaacgtactgaactttcaatctacttgcggacctcttaattcttcttcgctacatacacaacctcatcgcagactctacgcgcatatccccactcattatcataccatgcaactaatttcataaaacgcgagttcaacgcgatgcccgcttttgcgtcaaagatcatcgaatagttgctcccaacgaaatcggtggaaacaacgtcttcttccgtatagtcgacaatgcctttctcgatgcccgggtgtttaccgtcggctgcgtctttcagagctcgcagggtaccaccagtgttgtggcataaaaaagcaccgactcggtgccactttttcaagttgataacggactagccttattttaacttgctatttctagctctaaaaccactgctgacagtggtcccccattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcactgaggtaccaccagtgttgtggcataaaaaagcaccgactcggtgccactttttcaagttgataacggactagccttattttaacttgctatttctagctctaaaacccgtgttcaatcgtgataagcattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcaagccggtaccaccagtgttgtggcataaaaaagcaccgactcggtgccactttttcaagttgataacggactagccttattttaacttgctatttctagctctaaaacttgcggtataaccggagatgcattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcatgttggtaccaccagtgttgtggcataaaaaagcaccgactcggtgccactttttcaagttgataacggactagccttattttaacttgctatttctagctctaaaactcatggagccagatatccaacattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcaaggtggtacctggtgcgatcgctgttggcgcgccgtgtttaattaaggttgcggccgcttacttcgtccgagcctagttcgagccttgacaggatatattggcgggtaaactaagtcgctgtatgtgtttgtttgagatctcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaagaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgtgtaacattggtctagtgattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattg

SEQ ID NO: 603 - DNA, 11431 bp, synthetic construct
  source 1..11431: mol_type = other DNA
cagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcgatccccatccaacagcccgccgtcgagcgggcttttttatccccggaagcctgtggatagagggtagttatccacgtgaaaccgctaatgccccgcaaagccttgattcacggggctttccggcccgctccaaaaactatccacgtgaaatcgctaatcagggtacgtgaaatcgctaatcggagtacgtgaaatcgctaataaggtcacgtgaaatcgctaatcaaaaaggcacgtgagaacgctaatagccctttcagatcaacagcttgcaaacacccctcgctccggcaagtagttacagcaagtagtatgttcaattagcttttcaattatgaatatatatatcaattattggtcgcccttggcttgtggacaatgcgctacgcgcaccggctccgcccgtggacaaccgcaagcggttgcccaccgtcgagcgcctttgcccacaacccggcggccggccgcaacagatcgttttataaatttttttttttgaaaaagaaaaagcccgaaaggcggcaacctctcgggcttctggatttccgatccccggaattagatcttggcaggatatattgtggtgtaacgttggatctggctgagaacgccagctgtgcatgcttggtctagaatacgatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcatagtgatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctacttcagacttttctttttttttttggtgctgctgggactccatggattccatctcctcccaattgtgacaaatcgattcttgtttcatacaatcctgtgattgattgatggatcaatgttgcatccaagacttcttttgttgatgtatatctttttctatcgattgttgtatcgaaatatttgaatgctgctggtgctcccaagtttgtcaatgtgaacaaatggatgatgttttctgcttgttctctgattggtttatctctatgtttgttatatgctgacaagactttatccaagtttgcatctgccaagatgactctttttgagaattctgagatttgttcgatgatttcatccaaataatgtttatgttgttcgacgaacaattgtttttgttcgttatcttctggtgatcctttcaatttttcataatgtgatgccaaatacaagaagttgacatattttgatggcaatgccaattcgtttcctttttgcaattctcctgctgatgccaacattctttttcttccgttttccaattcgaacaatgaatattttggcaatttgatgatcaaatcttttttgacttctttatatccttttgcttccaagaaatcgattgggtttttttcgaatgatgatctttccatgattgtgattcccaacaattctttgactgatttcaatttttttgattttcctttttcgacttttgcgacgaccaagactgaatatgcgactgttggtgaatcgaatcctccatatttttttggatcccaatctttttttcttgcgatcaatttatctgagtttctttttggcaagattgattcttttgagaatcctcctgtttggacttctgtttttttgacgatgttgacttgtggcattgacaagacttttctgactgttgcgaaatctcttcctttatcccagacgatttctcctgtttctccgtttgtttcgatcaatggtctttttctgatttctccgtttgccaatgtgatttctgttttgaagaagttcatgatgtttgaatagaagaaatattttgctgttgcttttccgatttcttgttctgattttgcgatcatttttctgacatcatagactttataatctccatagacgaattctgattccaattttggatattttttgatcaatgctgttccgacgactgcgttcaaatatgcatcatgtgcatgatgatagttgttgatttctctgactttatagaattggaaatcttttctgaaatctgaaaccaattttgatttcaatgtgatgactttgacttctctgatcaatttatcgttttcatcatattttgtgttcattcttgaatccaagatttgtgcgacatgttttgtgatttgtcttgtttcgaccaattgtcttttgatgaatcctgctttatccaattctgacaatcctcctctttctgcttttgtcaagttatcgaattttctttgtgtgatcaattttgcgttcaacaattgtctccaatagtttttcatttttttgacgacttcttctgatgggacgttatctgattttcctctgtttttatctgatcttgtcaagactttgttatcgattgaatcatctttcaagaatgattgtgggacgatatgatcgacatcataatctgacaatctgttgatatccaattcttgatcgacatacatatctcttccgttttgcaaataatacaaatacaatttttcgttttgcaattgtgtgttttcgactggatgttctttcaagatttgtgatcccaattctttgattccttcttcgattcttttcattctttctcttgagtttttttgtcctttttgtgttgtttggttttctcttgccatttcgatgacgatgttttctggtttatgtcttcccatgactttgaccaattcatcgacgactttgactgtttgcaagattccttttttgattgctggtgatcctgccaagtttgcgatatgttcatgcaatgaatctccttgtcctgagacttgtgctttttggatatcttctttgaatgtcaatgaatcatcatggatcaattgcatgaagtttctgtttgcgaatccatctgatttcaagaaatccaagattgtttttcctgattgtttatctctgattccgttgatcaattttcttgacaatcttccccatcctgtatatcttcttcttttcaattgtttcatgactttatcatcgaacaaatgtgcatatgttttcaatctttcttcgatcatttctctatcttcgaacaatgtcaatgtcaagacgatatcttccaagatatcttcgttttcttcgttatccaagaaatctttatctttgatgattttcaacaaatcatgatatgttcccaatgatgcgttgaatctatcttcgactcctgagatttcgactgaatcgaagcattcgatttttttgaaataatcttctttcaattgtttgactgtgacttttctgtttgttttgaacaacaaatcgacgattgcttttttttgttctcctgacaagaatgctggttttctcattccttctgtgacatatttgacttttgtcaattcgttatagactgtgaaatattcatacaacaatgaatgttttggcaagactttttcgtttggcaagtttttatcgaagtttgtcattctttcgatgaatgattgtgctgatgctcctttatcgacgacttcttcgaagttccatggtgtgattgtttcttctgattttcttgtcatccatgcgaatcttgagtttcctcttgccaatggtccgacataatatgggattctgaatgtcaagattttttcgattttttctctgttatctttcaagaatggatagaaatcttcttgtcttctcaagattgcatgcaattctcccaaatggatttgatgtgggattgatccgttatcgaatgttctttgttttctcaacaaatcttctctgttcaatttgaccaacaattcttctgttccatccattttttccaagattggtttgatgaatttatagaattcttcttgtgatgctcctccatcgatatatcctgcatatccgttttttgattgatcgaagaagatttctttatatttttctggcaattgttgtctgaccaatgctttcaacaatgtcaaatcttgatgatgttcatcatatcttttgatcattgatgctgacaatggtgcttttgtgatttctgtgttgactctcaagatatctgacaacaagattgcatctgacaagttttttgctgccaagaacaaatctgcatattgatctccgatttgtgccaacaagttatccaaatcatcatcatatgtatcttttgacaattgcaattttgcatcttctgccaaatcgaagtttgatttgaagtttggtgtcaatcccaatgacaatgcgatcaagtttccgaacaatccgttttttttttctcctggcaattgtgcgatcaagttttccaatcttcttgattttgacaatcttgctgacaagattgcttttgcatcgactcctgatgcgttgattgggttttcttcgaacaattggttatatgtttggaccaattggatgaacaatttatcgacatctgagttatctgggttcaaatctccttcgatcaagaaatgtcctctgaatttgatcatatgtgccaatgccaaatagatcaatctcaaatctgctttatctgttgaatcgaccaatttttttctcaaatgatagattgttggatatttttcatgatatgcgacttcatcgacgatgtttccgaagattggatgtctttcatgttttttatcttcttcgaccaagaatgattcttccaatctatggaagaatgaatcatcgacttttgccatttcgtttgagaagatttcttgcaaatagcagattctgttttttcttcttgtatatcttcttcttgctgttcttttcaatcttgttgcttctgctgtttctcctgaatcgaacaacaatgctccgatcaagttttttttgattgaatgtctatctgtgtttcccaagactttgaatttttttgatgggactttatattcatctgtgatgactgcccatccgactgagtttgttccgatatccaatccgattgaatattttttatctgctgctgggactccatggattccgacttttctttttttttttggtgctgctttatcatcatcatctttataatcgatatcatgatctttataatctccatcatgatctttataatctttaacctacaagtcgacatcagtgagctgctgggtggtatgcaagcgagagacaaaccatggtaccggcgatgagcttgttgtgtgtagatgggagaaaacggagatggtggatgtgaccggaattggggtttttgtactatcgatgtcatcacaaattattatcatatcagattgctaacccctaaacaccgagaacattcgagacgcgggaacagcagctctagatcctcaacgcttataaactgctagcctgacacagaatgacgcaagcctcgaaaatgctctattgttaaaaacgtactgaactttcaatctacttgcggacctcttaattcttcttcgctacatacacaacctcatcgcagactctacgcgcatatccccactcattatcataccatgcaactaatttcataaaacgcgagttcaacgcgatgcccgcttttgcgtcaaagatcatcgaatagttgctcccaacgaaatcggtggaaacaacgtcttcttccgtatagtcgacaatgcctttctcgatgcccgggtgtttaccgtcggctgcgtctttcagagctcgcagggtaccaccagtgttgtggcataaaaaagcaccgactcggtgccactttttcaagttgataacggactagccttattttaacttgctatttctagctctaaaaccactgctgacagtggtcccccattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcactgaggtaccaccagtgttgtggcataaaaaagcaccgactcggtgccactttttcaagttgataacggactagccttattttaacttgctatttctagctctaaaactcgtttgatggtaccagcaacattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcaagccggtaccaccagtgttgtggcataaaaaagcaccgactcggtgccactttttcaagttgataacggactagccttattttaacttgctatttctagctctaaaaccctatagtctcctccttcgacattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcatgttggtaccaccagtgttgtggcataaaaaagcaccgactcggtgccactttttcaagttgataacggactagccttattttaacttgctatttctagctctaaaaccagattggtgaaatgttcaccattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcaaggtggtacctggtgcgatcgctgttggcgcgccgtgtttaattaaggttgcggccgcttacttcgtccgagcctagttcgagccttgacaggatatattggcgggtaaactaagtcgctgtatgtgtttgtttgagatctcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaagaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgtgtaacattggtctagtgattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattg

SEQ ID NO: 604 - DNA, 11346 bp, synthetic construct
  source 1..11346: mol_type = other DNA
cagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcgatccccatccaacagcccgccgtcgagcgggcttttttatccccggaagcctgtggatagagggtagttatccacgtgaaaccgctaatgccccgcaaagccttgattcacggggctttccggcccgctccaaaaactatccacgtgaaatcgctaatcagggtacgtgaaatcgctaatcggagtacgtgaaatcgctaataaggtcacgtgaaatcgctaatcaaaaaggcacgtgagaacgctaatagccctttcagatcaacagcttgcaaacacccctcgctccggcaagtagttacagcaagtagtatgttcaattagcttttcaattatgaatatatatatcaattattggtcgcccttggcttgtggacaatgcgctacgcgcaccggctccgcccgtggacaaccgcaagcggttgcccaccgtcgagcgcctttgcccacaacccggcggccggccgcaacagatcgttttataaatttttttttttgaaaaagaaaaagcccgaaaggcggcaacctctcgggcttctggatttccgatccccggaattagatcttggcaggatatattgtggtgtaacgttggatctggctgagaacgccagctgtgcatgcttggtctagaatacgatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcatagtgatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctacttcagacttttctttttttttttggtgctgctgggactccatggattccatctcctcccaattgtgacaaatcgattcttgtttcatacaatcctgtgattgattgatggatcaatgttgcatccaagacttcttttgttgatgtatatctttttctatcgattgttgtatcgaaatatttgaatgctgctggtgctcccaagtttgtcaatgtgaacaaatggatgatgttttctgcttgttctctgattggtttatctctatgtttgttatatgctgacaagactttatccaagtttgcatctgccaagatgactctttttgagaattctgagatttgttcgatgatttcatccaaataatgtttatgttgttcgacgaacaattgtttttgttcgttatcttctggtgatcctttcaatttttcataatgtgatgccaaatacaagaagttgacatattttgatggcaatgccaattcgtttcctttttgcaattctcctgctgatgccaacattctttttcttccgttttccaattcgaacaatgaatattttggcaatttgatgatcaaatcttttttgacttctttatatccttttgcttccaagaaatcgattgggtttttttcgaatgatgatctttccatgattgtgattcccaacaattctttgactgatttcaatttttttgattttcctttttcgacttttgcgacgaccaagactgaatatgcgactgttggtgaatcgaatcctccatatttttttggatcccaatctttttttcttgcgatcaatttatctgagtttctttttggcaagattgattcttttgagaatcctcctgtttggacttctgtttttttgacgatgttgacttgtggcattgacaagacttttctgactgttgcgaaatctcttcctttatcccagacgatttctcctgtttctccgtttgtttcgatcaatggtctttttctgatttctccgtttgccaatgtgatttctgttttgaagaagttcatgatgtttgaatagaagaaatattttgctgttgcttttccgatttcttgttctgattttgcgatcatttttctgacatcatagactttataatctccatagacgaattctgattccaattttggatattttttgatcaatgctgttccgacgactgcgttcaaatatgcatcatgtgcatgatgatagttgttgatttctctgactttatagaattggaaatcttttctgaaatctgaaaccaattttgatttcaatgtgatgactttgacttctctgatcaatttatcgttttcatcatattttgtgttcattcttgaatccaagatttgtgcgacatgttttgtgatttgtcttgtttcgaccaattgtcttttgatgaatcctgctttatccaattctgacaatcctcctctttctgcttttgtcaagttatcgaattttctttgtgtgatcaattttgcgttcaacaattgtctccaatagtttttcatttttttgacgacttcttctgatgggacgttatctgattttcctctgtttttatctgatcttgtcaagactttgttatcgattgaatcatctttcaagaatgattgtgggacgatatgatcgacatcataatctgacaatctgttgatatccaattcttgatcgacatacatatctcttccgttttgcaaataatacaaatacaatttttcgttttgcaattgtgtgttttcgactggatgttctttcaagatttgtgatcccaattctttgattccttcttcgattcttttcattctttctcttgagtttttttgtcctttttgtgttgtttggttttctcttgccatttcgatgacgatgttttctggtttatgtcttcccatgactttgaccaattcatcgacgactttgactgtttgcaagattccttttttgattgctggtgatcctgccaagtttgcgatatgttcatgcaatgaatctccttgtcctgagacttgtgctttttggatatcttctttgaatgtcaatgaatcatcatggatcaattgcatgaagtttctgtttgcgaatccatctgatttcaagaaatccaagattgtttttcctgattgtttatctctgattccgttgatcaattttcttgacaatcttccccatcctgtatatcttcttcttttcaattgtttcatgactttatcatcgaacaaatgtgcatatgttttcaatctttcttcgatcatttctctatcttcgaacaatgtcaatgtcaagacgatatcttccaagatatcttcgttttcttcgttatccaagaaatctttatctttgatgattttcaacaaatcatgatatgttcccaatgatgcgttgaatctatcttcgactcctgagatttcgactgaatcgaagcattcgatttttttgaaataatcttctttcaattgtttgactgtgacttttctgtttgttttgaacaacaaatcgacgattgcttttttttgttctcctgacaagaatgctggttttctcattccttctgtgacatatttgacttttgtcaattcgttatagactgtgaaatattcatacaacaatgaatgttttggcaagactttttcgtttggcaagtttttatcgaagtttgtcattctttcgatgaatgattgtgctgatgctcctttatcgacgacttcttcgaagttccatggtgtgattgtttcttctgattttcttgtcatccatgcgaatcttgagtttcctcttgccaatggtccgacataatatgggattctgaatgtcaagattttttcgattttttctctgttatctttcaagaatggatagaaatcttcttgtcttctcaagattgcatgcaattctcccaaatggatttgatgtgggattgatccgttatcgaatgttctttgttttctcaacaaatcttctctgttcaatttgaccaacaattcttctgttccatccattttttccaagattggtttgatgaatttatagaattcttcttgtgatgctcctccatcgatatatcctgcatatccgttttttgattgatcgaagaagatttctttatatttttctggcaattgttgtctgaccaatgctttcaacaatgtcaaatcttgatgatgttcatcatatcttttgatcattgatgctgacaatggtgcttttgtgatttctgtgttgactctcaagatatctgacaacaagattgcatctgacaagttttttgctgccaagaacaaatctgcatattgatctccgatttgtgccaacaagttatccaaatcatcatcatatgtatcttttgacaattgcaattttgcatcttctgccaaatcgaagtttgatttgaagtttggtgtcaatcccaatgacaatgcgatcaagtttccgaacaatccgttttttttttctcctggcaattgtgcgatcaagttttccaatcttcttgattttgacaatcttgctgacaagattgcttttgcatcgactcctgatgcgttgattgggttttcttcgaacaattggttatatgtttggaccaattggatgaacaatttatcgacatctgagttatctgggttcaaatctccttcgatcaagaaatgtcctctgaatttgatcatatgtgccaatgccaaatagatcaatctcaaatctgctttatctgttgaatcgaccaatttttttctcaaatgatagattgttggatatttttcatgatatgcgacttcatcgacgatgtttccgaagattggatgtctttcatgttttttatcttcttcgaccaagaatgattcttccaatctatggaagaatgaatcatcgacttttgccatttcgtttgagaagatttcttgcaaatagcagattctgttttttcttcttgtatatcttcttcttgctgttcttttcaatcttgttgcttctgctgtttctcctgaatcgaacaacaatgctccgatcaagttttttttgattgaatgtctatctgtgtttcccaagactttgaatttttttgatgggactttatattcatctgtgatgactgcccatccgactgagtttgttccgatatccaatccgattgaatattttttatctgctgctgggactccatggattccgacttttctttttttttttggtgctgctttatcatcatcatctttataatcgatatcatgatctttataatctccatcatgatctttataatctttaacctacaagtcgacatcagtgagctgctgggtggtatgcaagcgagagacaaaccatggtaccggcgatgagcttgttgtgtgtagatgggagaaaacggagatggtggatgtgaccggaattggggtttttgtactatcgatgtcatcacaaattattatcatatcagattgctaacccctaaacaccgagaacattcgagacgcgggaacagcagctctagatcctcaacgcttataaactgctagcctgacacagaatgacgcaagcctcgaaaatgctctattgttaaaaacgtactgaactttcaatctacttgcggacctcttaattcttcttcgctacatacacaacctcatcgcagactctacgcgcatatccccactcattatcataccatgcaactaatttcataaaacgcgagttcaacgcgatgcccgcttttgcgtcaaagatcatcgaatagttgctcccaacgaaatcggtggaaacaacgtcttcttccgtatagtcgacaatgcctttctcgatgcccgggtgtttaccgtcggctgcgtctttcagagctcgcagggtaccaatttacagggaatgaaggtaaaggttatctaggatccacctgacttgtacagctcgtccatgccgtgagtgatcccggcggcggtcacgaactccagcaggaccatgtgatcgcgcttctcgttggggtctttgctcagcttggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtgaaggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccatggagccggtaccaccagtgttgtggcataaaaaagcaccgactcggtgccactttttcaagttgataacggactagccttattttaacttgctatttctagctctaaaaccctatagtctcctccttcgacattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcatgttggtaccaccagtgttgtggcataaaaaagcaccgactcggtgccactttttcaagttgataacggactagccttattttaacttgctatttctagctctaaaaccagattggtgaaatgttcaccattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcaaggtggtacctggtgcgatcgctgttggcgcgccgtgtttaattaaggttgcggccgcttacttcgtccgagcctagttcgagccttgacaggatatattggcgggtaaactaagtcgctgtatgtgtttgtttgagatctcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaagaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgtgtaacattggtctagtgattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattg

SEQ ID NO: 605 - DNA, 12289 bp, synthetic construct
  source 1..12289: mol_type = other DNA
cagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcgatccccatccaacagcccgccgtcgagcgggcttttttatccccggaagcctgtggatagagggtagttatccacgtgaaaccgctaatgccccgcaaagccttgattcacggggctttccggcccgctccaaaaactatccacgtgaaatcgctaatcagggtacgtgaaatcgctaatcggagtacgtgaaatcgctaataaggtcacgtgaaatcgctaatcaaaaaggcacgtgagaacgctaatagccctttcagatcaacagcttgcaaacacccctcgctccggcaagtagttacagcaagtagtatgttcaattagcttttcaattatgaatatatatatcaattattggtcgcccttggcttgtggacaatgcgctacgcgcaccggctccgcccgtggacaaccgcaagcggttgcccaccgtcgagcgcctttgcccacaacccggcggccggccgcaacagatcgttttataaatttttttttttgaaaaagaaaaagcccgaaaggcggcaacctctcgggcttctggatttccgatccccggaattagatcttggcaggatatattgtggtgtaacgttggatctggctgagaacgccagctgtgcatgcttggtctagaatacgatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcatagtgatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctacttcagacttttctttttttttttggtgctgctgggactccatggattccatctcctcccaattgtgacaaatcgattcttgtttcatacaatcctgtgattgattgatggatcaatgttgcatccaagacttcttttgttgatgtatatctttttctatcgattgttgtatcgaaatatttgaatgctgctggtgctcccaagtttgtcaatgtgaacaaatggatgatgttttctgcttgttctctgattggtttatctctatgtttgttatatgctgacaagactttatccaagtttgcatctgccaagatgactctttttgagaattctgagatttgttcgatgatttcatccaaataatgtttatgttgttcgacgaacaattgtttttgttcgttatcttctggtgatcctttcaatttttcataatgtgatgccaaatacaagaagttgacatattttgatggcaatgccaattcgtttcctttttgcaattctcctgctgatgccaacattctttttcttccgttttccaattcgaacaatgaatattttggcaatttgatgatcaaatcttttttgacttctttatatccttttgcttccaagaaatcgattgggtttttttcgaatgatgatctttccatgattgtgattcccaacaattctttgactgatttcaatttttttgattttcctttttcgacttttgcgacgaccaagactgaatatgcgactgttggtgaatcgaatcctccatatttttttggatcccaatctttttttcttgcgatcaatttatctgagtttctttttggcaagattgattcttttgagaatcctcctgtttggacttctgtttttttgacgatgttgacttgtggcattgacaagacttttctgactgttgcgaaatctcttcctttatcccagacgatttctcctgtttctccgtttgtttcgatcaatggtctttttctgatttctccgtttgccaatgtgatttctgttttgaagaagttcatgatgtttgaatagaagaaatattttgctgttgcttttccgatttcttgttctgattttgcgatcatttttctgacatcatagactttataatctccatagacgaattctgattccaattttggatattttttgatcaatgctgttccgacgactgcgttcaaatatgcatcatgtgcatgatgatagttgttgatttctctgactttatagaattggaaatcttttctgaaatctgaaaccaattttgatttcaatgtgatgactttgacttctctgatcaatttatcgttttcatcatattttgtgttcattcttgaatccaagatttgtgcgacatgttttgtgatttgtcttgtttcgaccaattgtcttttgatgaatcctgctttatccaattctgacaatcctcctctttctgcttttgtcaagttatcgaattttctttgtgtgatcaattttgcgttcaacaattgtctccaatagtttttcatttttttgacgacttcttctgatgggacgttatctgattttcctctgtttttatctgatcttgtcaagactttgttatcgattgaatcatctttcaagaatgattgtgggacgatatgatcgacatcataatctgacaatctgttgatatccaattcttgatcgacatacatatctcttccgttttgcaaataatacaaatacaatttttcgttttgcaattgtgtgttttcgactggatgttctttcaagatttgtgatcccaattctttgattccttcttcgattcttttcattctttctcttgagtttttttgtcctttttgtgttgtttggttttctcttgccatttcgatgacgatgttttctggtttatgtcttcccatgactttgaccaattcatcgacgactttgactgtttgcaagattccttttttgattgctggtgatcctgccaagtttgcgatatgttcatgcaatgaatctccttgtcctgagacttgtgctttttggatatcttctttgaatgtcaatgaatcatcatggatcaattgcatgaagtttctgtttgcgaatccatctgatttcaagaaatccaagattgtttttcctgattgtttatctctgattccgttgatcaattttcttgacaatcttccccatcctgtatatcttcttcttttcaattgtttcatgactttatcatcgaacaaatgtgcatatgttttcaatctttcttcgatcatttctctatcttcgaacaatgtcaatgtcaagacgatatcttccaagatatcttcgttttcttcgttatccaagaaatctttatctttgatgattttcaacaaatcatgatatgttcccaatgatgcgttgaatctatcttcgactcctgagatttcgactgaatcgaagcattcgatttttttgaaataatcttctttcaattgtttgactgtgacttttctgtttgttttgaacaacaaatcgacgattgcttttttttgttctcctgacaagaatgctggttttctcattccttctgtgacatatttgacttttgtcaattcgttatagactgtgaaatattcatacaacaatgaatgttttggcaagactttttcgtttggcaagtttttatcgaagtttgtcattctttcgatgaatgattgtgctgatgctcctttatcgacgacttcttcgaagttccatggtgtgattgtttcttctgattttcttgtcatccatgcgaatcttgagtttcctcttgccaatggtccgacataatatgggattctgaatgtcaagattttttcgattttttctctgttatctttcaagaatggatagaaatcttcttgtcttctcaagattgcatgcaattctcccaaatggatttgatgtgggattgatccgttatcgaatgttctttgttttctcaacaaatcttctctgttcaatttgaccaacaattcttctgttccatccattttttccaagattggtttgatgaatttatagaattcttcttgtgatgctcctccatcgatatatcctgcatatccgttttttgattgatcgaagaagatttctttatatttttctggcaattgttgtctgaccaatgctttcaacaatgtcaaatcttgatgatgttcatcatatcttttgatcattgatgctgacaatggtgcttttgtgatttctgtgttgactctcaagatatctgacaacaagattgcatctgacaagttttttgctgccaagaacaaatctgcatattgatctccgatttgtgccaacaagttatccaaatcatcatcatatgtatcttttgacaattgcaattttgcatcttctgccaaatcgaagtttgatttgaagtttggtgtcaatcccaatgacaatgcgatcaagtttccgaacaatccgttttttttttctcctggcaattgtgcgatcaagttttccaatcttcttgattttgacaatcttgctgacaagattgcttttgcatcgactcctgatgcgttgattgggttttcttcgaacaattggttatatgtttggaccaattggatgaacaatttatcgacatctgagttatctgggttcaaatctccttcgatcaagaaatgtcctctgaatttgatcatatgtgccaatgccaaatagatcaatctcaaatctgctttatctgttgaatcgaccaatttttttctcaaatgatagattgttggatatttttcatgatatgcgacttcatcgacgatgtttccgaagattggatgtctttcatgttttttatcttcttcgaccaagaatgattcttccaatctatggaagaatgaatcatcgacttttgccatttcgtttgagaagatttcttgcaaatagcagattctgttttttcttcttgtatatcttcttcttgctgttcttttcaatcttgttgcttctgctgtttctcctgaatcgaacaacaatgctccgatcaagttttttttgattgaatgtctatctgtgtttcccaagactttgaatttttttgatgggactttatattcatctgtgatgactgcccatccgactgagtttgttccgatatccaatccgattgaatattttttatctgctgctgggactccatggattccgacttttctttttttttttggtgctgctttatcatcatcatctttataatcgatatcatgatctttataatctccatcatgatctttataatctttaacctacaagtcgacatcagtgagctgctgggtggtatgcaagcgagagacaaaccatggtaccggcgatgagcttgttgtgtgtagatgggagaaaacggagatggtggatgtgaccggaattggggtttttgtactatcgatgtcatcacaaattattatcatatcagattgctaacccctaaacaccgagaacattcgagacgcgggaacagcagctctagatcctcaacgcttataaactgctagcctgacacagaatgacgcaagcctcgaaaatgctctattgttaaaaacgtactgaactttcaatctacttgcggacctcttaattcttcttcgctacatacacaacctcatcgcagactctacgcgcatatccccactcattatcataccatgcaactaatttcataaaacgcgagttcaacgcgatgcccgcttttgcgtcaaagatcatcgaatagttgctcccaacgaaatcggtggaaacaacgtcttcttccgtatagtcgacaatgcctttctcgatgcccgggtgtttaccgtcggctgcgtctttcagagctcgcagggtaccaccagtgttgtggcataaaaaagcaccgactcggtgccactttttcaagttgataacggactagccttattttaacttgctatttctagctctaaaactcggatatgtgtcgtacgaccattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcactgaggtaccaccagtgttgtggcataaaaaagcaccgactcggtgccactttttcaagttgataacggactagccttattttaacttgctatttctagctctaaaactcgtttgatggtaccagcaacattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcaagcctgttggtaccagtcgactgaatactgttggctgtggtgagagaaacagagcgtgagctcaaatacacaagtacgaaatcagagttatgagagaggatttggagaaagaagatcacctgaagatcgtttgcgtcgcgcgaatgagagagacggcagagaaaacgagaagctttaagaggacgaacaaaaaccctaatgtcactccttttatatagatgagaaatttagggtttgggctctaatggagctgtctacatgggctttcatttctttatccagtaaagaaccggtttaacaggttccctggtttatacgtggttttagccggttaacttacggaatattatttttatcttaagttacacaaattacatcattaatagtaaaacaaaattttatggtgcaatttaagtttttatgatgagtgaaattcgaataatatacaaatattttactgtttaggtttccctaaacctacttttagatatgtaaattaaacatttttttttttttggttagaaccaagtcagtgatcatagaactcaaaaagctggtgtttcaattggtacaagcatttttattgcaagatataaaaattcagaaggacatatccttgatgtatgtacatgaaggaaccgattttgactccaagctacaaagaagaagaagaatgatatacaaagaaaactgcatatcctcaccatgaaattgaaagctagaggaaggggaataacagatactctgcgtagaagagattccatataaaccgataatatcctgagatagcttcctgcaataatcaaatgtttctacactccgttagatatacactccattgatgttccgtgataacgagtttatgtttgtacaaaagtattttaccttggtgtagtttgctttttctagtacccatgtctaccaaagatcaacaacaaagatattagagattaatgaatttggcagtgtcaaatgcagaaactaaagcatatagttatgaagttcttgtgcattatctcaaaagtatgtaagagatataagagtatctcataatgctttacctggaaaattaagcctgaagccaagatcacatgtgcaggaatcatcaagctacctctaaaaacctgttcattgttaaaggataagagggttggtcttttcaaagctgcatactgaggaaagtaacaatatcgcaacaaaaataaattggtggcgatagtttatcaagcttctacatgcagtaatggtgttcgtgctttaattaaccgaaatagttaagacggaaatagatgaattcacctgaggcatgtagaaagctagtgatatggctgaaacataatttactagcagaagtccagaaccgaggaatgcaatgtttctcactccaagttttgttgccagggttgatatttggaacctattcaagatcaatcaaaggcatgattaactaaacatgcttgaacaaacacataaagacaatatatcaaacggagctggttaaacattgtctttgactgtcaaatggattgagccaaagagcggaaagaaaatggttatgcgtgcagttacttactttcgatctccttcaacatcaggaaggtcctttgtaatagcaatgaccagtgcaaacagtgtcacaaaagatgtgatgaacgccacaggtgcactgcaaatagcgaatcaaaagttgagtaatatatctactcacgattatggaggtggtacctggtgcgatcgctgttggcgcgccgtgtttaattaaggttgcggccgcttacttcgtccgagcctagttcgagccttgacaggatatattggcgggtaaactaagtcgctgtatgtgtttgtttgagatctcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaagaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgtgtaacattggtctagtgattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattg

SEQ ID NO: 606 - DNA, 10651 bp, synthetic construct
  source 1..10651: mol_type = other DNA
cagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcgatccccatccaacagcccgccgtcgagcgggcttttttatccccggaagcctgtggatagagggtagttatccacgtgaaaccgctaatgccccgcaaagccttgattcacggggctttccggcccgctccaaaaactatccacgtgaaatcgctaatcagggtacgtgaaatcgctaatcggagtacgtgaaatcgctaataaggtcacgtgaaatcgctaatcaaaaaggcacgtgagaacgctaatagccctttcagatcaacagcttgcaaacacccctcgctccggcaagtagttacagcaagtagtatgttcaattagcttttcaattatgaatatatatatcaattattggtcgcccttggcttgtggacaatgcgctacgcgcaccggctccgcccgtggacaaccgcaagcggttgcccaccgtcgagcgcctttgcccacaacccggcggccggccgcaacagatcgttttataaatttttttttttgaaaaagaaaaagcccgaaaggcggcaacctctcgggcttctggatttccgatccccggaattagatcttggcaggatatattgtggtgtaacgttggatctggctgagaacgccagctgtgcatgcttggtctagaatacgatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcatagtgatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctacttcagacttttctttttttttttggtgctgctgggactccatggattccatctcctcccaattgtgacaaatcgattcttgtttcatacaatcctgtgattgattgatggatcaatgttgcatccaagacttcttttgttgatgtatatctttttctatcgattgttgtatcgaaatatttgaatgctgctggtgctcccaagtttgtcaatgtgaacaaatggatgatgttttctgcttgttctctgattggtttatctctatgtttgttatatgctgacaagactttatccaagtttgcatctgccaagatgactctttttgagaattctgagatttgttcgatgatttcatccaaataatgtttatgttgttcgacgaacaattgtttttgttcgttatcttctggtgatcctttcaatttttcataatgtgatgccaaatacaagaagttgacatattttgatggcaatgccaattcgtttcctttttgcaattctcctgctgatgccaacattctttttcttccgttttccaattcgaacaatgaatattttggcaatttgatgatcaaatcttttttgacttctttatatccttttgcttccaagaaatcgattgggtttttttcgaatgatgatctttccatgattgtgattcccaacaattctttgactgatttcaatttttttgattttcctttttcgacttttgcgacgaccaagactgaatatgcgactgttggtgaatcgaatcctccatatttttttggatcccaatctttttttcttgcgatcaatttatctgagtttctttttggcaagattgattcttttgagaatcctcctgtttggacttctgtttttttgacgatgttgacttgtggcattgacaagacttttctgactgttgcgaaatctcttcctttatcccagacgatttctcctgtttctccgtttgtttcgatcaatggtctttttctgatttctccgtttgccaatgtgatttctgttttgaagaagttcatgatgtttgaatagaagaaatattttgctgttgcttttccgatttcttgttctgattttgcgatcatttttctgacatcatagactttataatctccatagacgaattctgattccaattttggatattttttgatcaatgctgttccgacgactgcgttcaaatatgcatcatgtgcatgatgatagttgttgatttctctgactttatagaattggaaatcttttctgaaatctgaaaccaattttgatttcaatgtgatgactttgacttctctgatcaatttatcgttttcatcatattttgtgttcattcttgaatccaagatttgtgcgacatgttttgtgatttgtcttgtttcgaccaattgtcttttgatgaatcctgctttatccaattctgacaatcctcctctttctgcttttgtcaagttatcgaattttctttgtgtgatcaattttgcgttcaacaattgtctccaatagtttttcatttttttgacgacttcttctgatgggacgttatctgattttcctctgtttttatctgatcttgtcaagactttgttatcgattgaatcatctttcaagaatgattgtgggacgatatgatcgacatcataatctgacaatctgttgatatccaattcttgatcgacatacatatctcttccgttttgcaaataatacaaatacaatttttcgttttgcaattgtgtgttttcgactggatgttctttcaagatttgtgatcccaattctttgattccttcttcgattcttttcattctttctcttgagtttttttgtcctttttgtgttgtttggttttctcttgccatttcgatgacgatgttttctggtttatgtcttcccatgactttgaccaattcatcgacgactttgactgtttgcaagattccttttttgattgctggtgatcctgccaagtttgcgatatgttcatgcaatgaatctccttgtcctgagacttgtgctttttggatatcttctttgaatgtcaatgaatcatcatggatcaattgcatgaagtttctgtttgcgaatccatctgatttcaagaaatccaagattgtttttcctgattgtttatctctgattccgttgatcaattttcttgacaatcttccccatcctgtatatcttcttcttttcaattgtttcatgactttatcatcgaacaaatgtgcatatgttttcaatctttcttcgatcatttctctatcttcgaacaatgtcaatgtcaagacgatatcttccaagatatcttcgttttcttcgttatccaagaaatctttatctttgatgattttcaacaaatcatgatatgttcccaatgatgcgttgaatctatcttcgactcctgagatttcgactgaatcgaagcattcgatttttttgaaataatcttctttcaattgtttgactgtgacttttctgtttgttttgaacaacaaatcgacgattgcttttttttgttctcctgacaagaatgctggttttctcattccttctgtgacatatttgacttttgtcaattcgttatagactgtgaaatattcatacaacaatgaatgttttggcaagactttttcgtttggcaagtttttatcgaagtttgtcattctttcgatgaatgattgtgctgatgctcctttatcgacgacttcttcgaagttccatggtgtgattgtttcttctgattttcttgtcatccatgcgaatcttgagtttcctcttgccaatggtccgacataatatgggattctgaatgtcaagattttttcgattttttctctgttatctttcaagaatggatagaaatcttcttgtcttctcaagattgcatgcaattctcccaaatggatttgatgtgggattgatccgttatcgaatgttctttgttttctcaacaaatcttctctgttcaatttgaccaacaattcttctgttccatccattttttccaagattggtttgatgaatttatagaattcttcttgtgatgctcctccatcgatatatcctgcatatccgttttttgattgatcgaagaagatttctttatatttttctggcaattgttgtctgaccaatgctttcaacaatgtcaaatcttgatgatgttcatcatatcttttgatcattgatgctgacaatggtgcttttgtgatttctgtgttgactctcaagatatctgacaacaagattgcatctgacaagttttttgctgccaagaacaaatctgcatattgatctccgatttgtgccaacaagttatccaaatcatcatcatatgtatcttttgacaattgcaattttgcatcttctgccaaatcgaagtttgatttgaagtttggtgtcaatcccaatgacaatgcgatcaagtttccgaacaatccgttttttttttctcctggcaattgtgcgatcaagttttccaatcttcttgattttgacaatcttgctgacaagattgcttttgcatcgactcctgatgcgttgattgggttttcttcgaacaattggttatatgtttggaccaattggatgaacaatttatcgacatctgagttatctgggttcaaatctccttcgatcaagaaatgtcctctgaatttgatcatatgtgccaatgccaaatagatcaatctcaaatctgctttatctgttgaatcgaccaatttttttctcaaatgatagattgttggatatttttcatgatatgcgacttcatcgacgatgtttccgaagattggatgtctttcatgttttttatcttcttcgaccaagaatgattcttccaatctatggaagaatgaatcatcgacttttgccatttcgtttgagaagatttcttgcaaatagcagattctgttttttcttcttgtatatcttcttcttgctgttcttttcaatcttgttgcttctgctgtttctcctgaatcgaacaacaatgctccgatcaagttttttttgattgaatgtctatctgtgtttcccaagactttgaatttttttgatgggactttatattcatctgtgatgactgcccatccgactgagtttgttccgatatccaatccgattgaatattttttatctgctgctgggactccatggattccgacttttctttttttttttggtgctgctttatcatcatcatctttataatcgatatcatgatctttataatctccatcatgatctttataatctttaacctacaagtcgacatcagtgagctgctgggtggtatgcaagcgagagacaaaccatggtaccggcgatgagcttgttgtgtgtagatgggagaaaacggagatggtggatgtgaccggaattggggtttttgtactatcgatgtcatcacaaattattatcatatcagattgctaacccctaaacaccgagaacattcgagacgcgggaacagcagctctagatcctcaacgcttataaactgctagcctgacacagaatgacgcaagcctcgaaaatgctctattgttaaaaacgtactgaactttcaatctacttgcggacctcttaattcttcttcgctacatacacaacctcatcgcagactctacgcgcatatccccactcattatcataccatgcaactaatttcataaaacgcgagttcaacgcgatgcccgcttttgcgtcaaagatcatcgaatagttgctcccaacgaaatcggtggaaacaacgtcttcttccgtatagtcgacaatgcctttctcgatgcccgggtgtttaccgtcggctgcgtctttcagagctcgcagggtaccaatttacagggaatgaaggtaaaggttatctaggatccacctgaggtaccaccagtgttgtggcataaaaaagcaccgactcggtgccactttttcaagttgataacggactagccttattttaacttgctatttctagctctaaaaccggggatgtgtggacgggcccattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcaagcctgttggtaccagtcgactgaatactgttggtaccaccagtgttgtggcataaaaaagcaccgactcggtgccactttttcaagttgataacggactagccttattttaacttgctatttctagctctaaaacctgagctgcattccagcaatcattagcgaatgtattacctgagacatctttgttaggattttgaatattgtctggcccgcggggtattattatgtaatccaaccaagccattgtctgctcccggcgaagtccggacacggtttcagtgctaccgcaaccaaaagccaccaacattccttgccttctgctttcttcatcaacggactactccttctgacttcgcctttattatcatgaactgtggcatctacctacccagaatcacttgttcttgaattagttgccttaatagtaagcaggccacaagaaggctttttggcaaggtggtacctggtgcgatcgctgttggcgcgccgtgtttaattaaggttgcggccgcttacttcgtccgagcctagttcgagccttgacaggatatattggcgggtaaactaagtcgctgtatgtgtttgtttgagatctcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaagaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgtgtaacattggtctagtgattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattg

SEQ ID NO: 607-639 - skipped (33 entries)

SEQ ID NO: 640 - DNA, 4227 bp, synthetic construct
  source 1..4227: mol_type = other DNA
atgccgcctaagaagaaacgcaaggttgaggataagaagtacagcatcggactcgacatcggtactaactcggtaggatgggcagtcatcacggatgaatacaaggttccttccaagaagtttaaggtccttggtaacaccgaccgccattctatcaagaagaacctcattggcgctttgctctttgactcaggagaaaccgctgaggcgacacgcctcaaacgcacggcacgtcgacgttatacacgcagaaagaatcgtatctgctatctgcaggaaatcttttcgaacgaaatggcaaaagttgatgacagcttcttccatcgcctggaggaatcgtttctcgtggaggaggacaagaagcacgagagacatcctatcttcggcaacattgtcgatgaggtcgcttaccacgagaagtaccctactatctaccaccttagaaagaagctcgtagactcaactgacaaagcggatcttcgtctgatctatttggctcttgcccacatgatcaagttccgtggtcattttctcatcgaaggcgaccttaatcccgacaactcggacgtcgataagctgtttatccagctcgtacagacatacaaccagctcttcgaagaaaacccaattaatgcttccggtgttgatgcaaaagctatcctcagcgcgagattgagcaagagcagacgcctcgaaaacctcatcgcccaattgcctggtgaaaagaagaacggcttgttcggcaatcttattgccctgagccttggcctcactccgaacttcaagtcgaacttcgatcttgcggaagatgccaagctgcaactctccaaggacacgtacgatgatgacttggacaatctccttgcccagattggcgatcaatacgccgatcttttcctcgcggcgaagaacttgtcggacgcaatcttgctctcagacatccttcgcgtcaacactgagatcaccaaagcccctctctctgcctcgatgatcaagcgctatgacgaacaccaccaggatctcacgctccttaaggcattggtgcgtcagcagttgcctgagaagtacaaagagattttctttgatcagtcgaagaacggatacgctggctacatcgacggtggcgcttctcaggaggagttctacaagtttatcaaacccattcttgagaagatggatggcacggaggagctcctcgtcaagctgaatcgcgaggacctcctccgtaagcaacgtacgttcgacaatggctcgattccacaccagattcatctgggcgaactccacgccatcctcaggaggcaggaggacttctatcccttcctcaaggataatcgagagaaaattgagaagatcctcacattccgcatcccctattatgtaggcccactcgctcgcggaaactctcgctttgcctggatgacccgcaagtcggaagaaacaatcaccccgtggaacttcgaagaggtggtggacaagggtgcatctgcgcagtcgtttattgagaggatgacaaactttgataagaacctcccgaatgagaaagtcctgccaaaacattccctcctgtatgaatacttcacggtctataacgaactgacaaaggtgaagtacgtgaccgagggtatgcgtaagcctgcctttctttcgggtgagcagaagaaagctattgtcgacttgttgttcaagaccaaccgcaaggtcactgtcaagcaactgaaggaagattacttcaagaaaatcgagtgttttgattcggtagagatctcgggcgtcgaggacaggttcaacgcctctctcggcacctatcacgatcttctcaagatcatcaaggacaaagactttcttgacaacgaagagaacgaggatattctcgaggacatcgtgctcaccctcactttgttcgaagatcgcgaaatgattgaggaacgtcttaagacatatgctcacttgttcgacgacaaagtgatgaagcagctgaagcgtaggcgatacacaggttggggccgcctctcgcgcaagctgattaacggtatccgcgacaagcaatccggcaagacaatcttggatttccttaagagcgacggttttgctaaccgcaacttcatgcagctcatccacgacgacagccttacgttcaaggaggacatccagaaggcccaggtttccggacaaggtgactctctccatgagcacatcgctaacctggcgggaagccccgcgatcaagaaaggtatcctccagaccgtcaaagttgtggacgagctggtcaaggtaatgggccgacacaaaccggagaacattgttatcgagatggcacgagagaatcagacgacccagaaaggccaaaagaactccagagaacgtatgaaacgaatcgaagagggtatcaaggaactgggatcgcagatcctgaaggagcaccccgttgagaacacgcagctccaaaacgaaaagctgtacctctactacttgcaaaatggtagggatatgtacgtcgaccaggaactggatattaatcgtctgtccgactacgacgttgaccacatcgtgccccaatcgtttctcaaggatgactcgatcgataataaagtacttacgcgctcagacaagaaccgaggtaaatcggacaatgtcccatcggaggaagtcgtgaagaagatgaagaactattggcgccaacttcttaacgcaaagctgatcacccagaggaaattcgacaacctcaccaaagcagaacgcggcggcctctccgagctcgacaaggctggatttatcaagcgtcagctcgtcgaaacgcgtcagattaccaagcacgtcgcacagatcctggatagccgcatgaacacaaagtacgacgaaaacgacaagctcatccgtgaggttaaggtcatcaccttgaagtcgaaactcgtgtcggacttccgcaaagattttcagttctataaagttagagagatcaacaactaccaccatgcgcatgacgcctacctcaatgccgtcgtgggcaccgcacttattaagaaatacccgaagctcgagtccgagtttgtctacggcgattacaaggtatacgacgttcgcaagatgattgccaaatcggagcaggagatcggtaaggccactgccaagtacttcttttactcgaacatcatgaatttcttcaaaacagaaatcaccctcgccaacggcgagattcgcaaacgaccactcatcgagactaacggtgaaacgggagagatcgtctgggataagggccgagactttgctacggttcgaaaggtcctttcgatgcctcaagtgaacatcgtcaagaaaacggaggtccaaaccggtggcttcagcaaggagtcgattctgccgaaacgcaattcggacaaattgattgcacgcaagaaggattgggaccctaagaaatatggcggcttcgattcaccgacagtggcctattcggttctggtcgtcgcgaaagtggagaagggcaagtcaaagaagctcaagtcagtgaaggagctcctgggaatcaccatcatggaacgttcctcttttgagaagaaccctatcgactttctcgaggctaagggctacaaagaggtcaagaaagatctcatcatcaaactcccaaaatactcacttttcgagctcgagaacggccgtaaacgaatgctggcgagcgcaggagagcttcaaaagggaaatgaactggctttgccctccaagtacgtcaacttcctctacctcgcaagccattatgagaagttgaagggtagccccgaggacaacgaacaaaagcagctcttcgtggagcaacacaaacattacctggatgaaatcatcgagcaaatctcggagtttagcaagcgagtgatcttggctgatgccaacctcgacaaggtgttgtctgcctacaacaagcatcgagataagccgattcgcgagcaggccgagaacatcatccacctcttcactctcactaacttgggtgcgcctgcggcgtttaaatactttgacacgaccatcgaccgcaagcgttacacaagcacgaaggaagtcctcgacgctacactgatccatcagtcgatcaccggtctgtacgaaacccgcatcgatctgtctcaactgggcggtgacagcggcggctacccatacgatgtgcccgattacgctagcggcggaaagcgtcccgcagccactaagaaggctggacaggccaagaagaagaagtga

SEQ ID NO: 641 - DNA, 4227 bp, synthetic construct
  source 1..4227: mol_type = other DNA
atgccgcctaagaagaaacgcaaggttgaggataagaagtacagcatcggactcgacatcggtactaactcggtaggatgggcagtcatcacggatgaatacaaggttccttccaagaagtttaaggtccttggtaacaccgacagacattctatcaagaagaacctcattggcgctttgctctttgactcaggagaaaccgctgaggcgacacgcctcaaacgcacggcacgtcgacgttatacacgcagaaagaatcgtatctgctatctgcaggaaatcttttcgaacgaaatggcaaaagttgatgacagcttcttccatcgcctggaggaatcgtttctcgtggaggaggacaagaagcacgagagacatcctatcttcggcaacattgtcgatgaggtcgcttaccacgagaagtaccctactatctaccaccttagaaagaagctcgtagactcaactgacaaagcggatcttcgtctgatctatttggctcttgcccacatgatcaagttccgtggtcattttctcatcgaaggcgaccttaatcccgacaactcggacgtcgataagctgtttatccagctcgtacagacatacaaccagctcttcgaagaaaacccaattaatgcttccggtgttgatgcaaaagctatcctcagcgcgagattgagcaagagcagacgcctcgaaaacctcatcgcccaattgcctggtgaaaagaagaacggcttgttcggcaatcttattgccctgagccttggcctcactccgaacttcaagtcgaacttcgatcttgcggaagatgccaagctgcaactctccaaggacacgtacgatgatgacttggacaatctccttgcccagattggcgatcaatacgccgatcttttcctcgcggcgaagaacttgtcggacgcaatcttgctctcagacatccttcgcgtcaacactgagatcaccaaagcccctctctctgcctcgatgatcaagcgctatgacgaacaccaccaggatctcacgctccttaaggcattggtgcgtcagcagttgcctgagaagtacaaagagattttctttgatcagtcgaagaacggatacgctggctacatcgacggtggcgcttctcaggaggagttctacaagtttatcaaacccattcttgagaagatggatggcacggaggagctcctcgtcaagctgaatcgcgaggacctcctccgtaagcaacgtacgttcgacaatggctcgattccacaccagattcatctgggcgaactccacgccatcctcaggaggcaggaggacttctatcccttcctcaaggataatcgagagaaaattgagaagatcctcacattccgcatcccctattatgtaggcccactcgctcgcggaaactctcgctttgcctggatgacccgcaagtcggaagaaacaatcaccccgtggaacttcgaagaggtggtggacaagggtgcatctgcgcagtcgtttattgagaggatgacaaactttgataagaacctcccgaatgagaaagtcctgccaaaacattccctcctgtatgaatacttcacggtctataacgaactgacaaaggtgaagtacgtgaccgagggtatgcgtaagcctgcctttctttcgggtgagcagaagaaagctattgtcgacttgttgttcaagaccaaccgcaaggtcactgtcaagcaactgaaggaagattacttcaagaaaatcgagtgttttgattcggtagagatctcgggcgtcgaggacaggttcaacgcctctctcggcacctatcacgatcttctcaagatcatcaaggacaaagactttcttgacaacgaagagaacgaggatattctcgaggacatcgtgctcaccctcactttgttcgaagatcgcgaaatgattgaggaacgtcttaagacatatgctcacttgttcgacgacaaagtgatgaagcagctgaagcgtaggcgatacacaggttggggccgcctctcgcgcaagctgattaacggtatccgcgacaagcaatccggcaagacaatcttggatttccttaagagcgacggttttgctaaccgcaacttcatgcagctcatccacgacgacagccttacgttcaaggaggacatccagaaggcccaggtttccggacaaggtgactctctccatgagcacatcgctaacctggcgggaagccccgcgatcaagaaaggtatcctccagaccgtcaaagttgtggacgagctggtcaaggtaatgggccgacacaaaccggagaacattgttatcgagatggcacgagagaatcagacgacccagaaaggccaaaagaactccagagaacgtatgaaacgaatcgaagagggtatcaaggaactgggatcgcagatcctgaaggagcaccccgttgagaacacgcagctccaaaacgaaaagctgtacctctactacttgcaaaatggtagggatatgtacgtcgaccaggaactggatattaatcgtctgtccgactacgacgttgaccacatcgtgccccaatcgtttctcaaggatgactcgatcgataataaagtacttacgcgctcagacaagaaccgaggtaaatcggacaatgtcccatcggaggaagtcgtgaagaagatgaagaactattggcgccaacttcttaacgcaaagctgatcacccagaggaaattcgacaacctcaccaaagcagaacgcggcggcctctccgagctcgacaaggctggatttatcaagcgtcagctcgtcgaaacgcgtcagattaccaagcacgtcgcacagatcctggatagccgcatgaacacaaagtacgacgaaaacgacaagctcatccgtgaggttaaggtcatcaccttgaagtcgaaactcgtgtcggacttccgcaaagattttcagttctataaagttagagagatcaacaactaccaccatgcgcatgacgcctacctcaatgccgtcgtgggcaccgcacttattaagaaatacccgaagctcgagtccgagtttgtctacggcgattacaaggtatacgacgttcgcaagatgattgccaaatcggagcaggagatcggtaaggccactgccaagtacttcttttactcgaacatcatgaatttcttcaaaacagaaatcaccctcgccaacggcgagattcgcaaacgaccactcatcgagactaacggtgaaacgggagagatcgtctgggataagggccgagactttgctacggttcgaaaggtcctttcgatgcctcaagtgaacatcgtcaagaaaacggaggtccaaaccggtggcttcagcaaggagtcgattctgccgaaacgcaattcggacaaattgattgcacgcaagaaggattgggaccctaagaaatatggcggcttcgattcaccgacagtggcctattcggttctggtcgtcgcgaaagtggagaagggcaagtcaaagaagctcaagtcagtgaaggagctcctgggaatcaccatcatggaacgttcctcttttgagaagaaccctatcgactttctcgaggctaagggctacaaagaggtcaagaaagatctcatcatcaaactcccaaaatactcacttttcgagctcgagaacggccgtaaacgaatgctggcgagcgcaggagagcttcaaaagggaaatgaactggctttgccctccaagtacgtcaacttcctctacctcgcaagccattatgagaagttgaagggtagccccgaggacaacgaacaaaagcagctcttcgtggagcaacacaaacattacctggatgaaatcatcgagcaaatctcggagtttagcaagcgagtgatcttggctgatgccaacctcgacaaggtgttgtctgcctacaacaagcatcgagataagccgattcgcgagcaggccgagaacatcatccacctcttcactctcactaacttgggtgcgcctgcggcgtttaaatactttgacacgaccatcgaccgcaagcgttacacaagcacgaaggaagtcctcgacgctacactgatccatcagtcgatcaccggtctgtacgaaacccgcatcgatctgtctcaactgggtggtgactcgggtggctacccatacgatgtgcccgattacgctagcggcggaaagcgtcccgcagccactaagaaggctggacaggccaagaagaagaagtga

SEQ ID NO: 642 - DNA, 4185 bp, synthetic construct
  source 1..4185: mol_type = other DNA
atggataagaagtactctatcggcctcgatatcggtaccaactctgtcggttgggctgtcatcaccgatgaatacaaggtcccttctaagaagttcaaggtcctcggtaacaccgatcgtcattctatcaagaagaacctcatcggtgctctcctcttcgattctggtgaaaccgctgaagctacccgtctcaagcgtaccgctcgtcgtcgttacacccgtcgtaagaaccgtatctgctacctccaagaaatcttctctaacgaaatggctaaggtcgatgattctttcttccatcgtctcgaagaatctttcctcgtcgaagaagataagaagcatgaacgtcatcctatcttcggtaacatcgtcgatgaagtcgcttaccatgaaaagtaccctaccatctaccatctccgtaagaagctcgtcgattctaccgataaggctgatctccgtctcatctacctcgctctcgctcatatgatcaagttccgtggtcatttcctcatcgaaggtgatctcaaccctgataactctgatgtcgataagctcttcatccaactcgtccaaacctacaaccaactcttcgaagaaaaccctatcaacgcttctggtgtcgatgctaaggctatcctctctgctcgtctctctaagtctcgtcgtctcgaaaacctcatcgctcaactccctggtgaaaagaagaacggcctcttcggtaacctcatcgctctctctctcggcctcacccctaacttcaagtctaacttcgatctcgctgaagatgctaagctccaactctctaaggatacctacgatgatgatctcgataacctcctcgctcaaatcggtgatcaatacgctgatctcttcctcgctgctaagaacctctctgatgctatcctcctctctgatatcctccgtgtcaacaccgaaatcaccaaggctcctctctctgcttctatgatcaagcgttacgatgaacatcatcaagatctcaccctcctcaaggctctcgtccgtcaacaactccctgaaaagtacaaggaaatcttcttcgatcaatctaagaacggttacgctggttacatcgatggtggtgcttctcaagaagaattctacaagttcatcaagcctatcctcgaaaagatggatggtaccgaagaactcctcgtcaagctcaaccgtgaagatctcctccgtaagcaacgtaccttcgataacggttctatccctcatcaaatccatctcggtgaactccatgctatcctccgtcgtcaagaagatttctaccctttcctcaaggataaccgtgaaaagatcgaaaagatcctcaccttccgtatcccttactacgtcggtcctctcgctcgtggtaactctcgtttcgcttggatgacccgtaagtctgaagaaaccatcaccccttggaacttcgaagaagtcgtcgataagggtgcttctgctcaatctttcatcgaacgtatgaccaacttcgataagaacctccctaacgaaaaggtcctccctaagcattctctcctctacgaatacttcaccgtctacaacgaactcaccaaggtcaagtacgtcaccgaaggtatgcgtaagcctgctttcctctctggtgaacaaaagaaggctatcgtcgatctcctcttcaagaccaaccgtaaggtcaccgtcaagcaactcaaggaagattacttcaagaagatcgaatgcttcgattctgtcgaaatctctggtgtcgaagatcgtttcaacgcttctctcggtacctaccatgatctcctcaagatcatcaaggataaggatttcctcgataacgaagaaaacgaagatatcctcgaagatatcgtcctcaccctcaccctcttcgaagatcgtgaaatgatcgaagaacgtctcaagacctacgctcatctcttcgatgataaggtcatgaagcaactcaagcgtcgtcgttacaccggttggggtcgtctctctcgtaagctcatcaacggtatccgtgataagcaatctggtaagaccatcctcgatttcctcaagtctgatggtttcgctaaccgtaacttcatgcaactcatccatgatgattctctcaccttcaaggaagatatccaaaaggctcaagtctctggtcaaggtgattctctccatgaacatatcgctaacctcgctggttctcctgctatcaagaagggtatcctccaaaccgtcaaggtcgtcgatgaactcgtcaaggtcatgggtcgtcataagcctgaaaacatcgtcatcgaaatggctcgtgaaaaccaaaccacccaaaagggtcaaaagaactctcgtgaacgtatgaagcgtatcgaagaaggtatcaaggaactcggttctcaaatcctcaaggaacatcctgtcgaaaacacccaactccaaaacgaaaagctctacctctactacctccaaaacggtcgtgatatgtacgtcgatcaagaactcgatatcaaccgtctctctgattacgatgtcgatcatatcgtccctcaatctttcctcaaggatgattctatcgataacaaggtcctcacccgttctgataagaaccgtggtaagtctgataacgtcccttctgaagaagtcgtcaagaagatgaagaactactggcgtcaactcctcaacgctaagctcatcacccaacgtaagttcgataacctcaccaaggctgaacgtggtggtctctctgaactcgataaggctggtttcatcaagcgtcaactcgtcgaaacccgtcaaatcaccaagcatgtcgctcaaatcctcgattctcgtatgaacaccaagtacgatgaaaacgataagctcatccgtgaagtcaaggtcatcaccctcaagtctaagctcgtctctgatttccgtaaggatttccaattctacaaggtccgtgaaatcaacaactaccatcatgctcatgatgcttacctcaacgctgtcgtcggtaccgctctcatcaagaagtaccctaagctcgaatctgaattcgtctacggtgattacaaggtctacgatgtccgtaagatgatcgctaagtctgaacaagaaatcggtaaggctaccgctaagtacttcttctactctaacatcatgaacttcttcaagaccgaaatcaccctcgctaacggtgaaatccgtaagcgtcctctcatcgaaaccaacggtgaaaccggtgaaatcgtctgggataagggtcgtgatttcgctaccgtccgtaaggtcctctctatgcctcaagtcaacatcgtcaagaagaccgaagtccaaaccggtggtttctctaaggaatctatcctccctaagcgtaactctgataagctcatcgctcgtaagaaggattgggatcctaagaagtacggtggtttcgattctcctaccgtcgcttactctgtcctcgtcgtcgctaaggtcgaaaagggtaagtctaagaagctcaagtctgtcaaggaactcctcggtatcaccatcatggaacgttcttctttcgaaaagaaccctatcgatttcctcgaagctaagggttacaaggaagtcaagaaggatctcatcatcaagctccctaagtactctctcttcgaactcgaaaacggtcgtaagcgtatgctcgcttctgctggtgaactccaaaagggtaacgaactcgctctcccttctaagtacgtcaacttcctctacctcgcttctcattacgaaaagctcaagggttctcctgaagataacgaacaaaagcaactcttcgtcgaacaacataagcattacctcgatgaaatcatcgaacaaatctctgaattctctaagcgtgtcatcctcgctgatgctaacctcgataaggtcctctctgcttacaacaagcatcgtgataagcctatccgtgaacaagctgaaaacatcatccatctcttcaccctcaccaacctcggtgctcctgctgctttcaagtacttcgataccaccatcgatcgtaagcgttacacctctaccaaggaagtcctcgatgctaccctcatccatcaatctatcaccggcctctacgaaacccgtatcgatctctctcaactcggtggtgatggtatccatggtgtccctgctgctcctaagaagaagcgtaagcctaagaagaagcgtaagcctaagaagaagcgtaagtaa

SEQ ID NO: 643 - DNA, 5031 bp, synthetic construct
  source 1..5031: mol_type = other DNA
atggataagaagtactctatcggcctcgatatcggtaccaactctgtcggttgggctgtcatcaccgatgaatacaaggtcccttctaagaagttcaaggtcctcggtaacaccgatcgtcattctatcaagaagaacctcatcggtgctctcctcttcgattctggtgaaaccgctgaagctacccgtctcaagcgtaccgctcgtcgtcgttacacccgtcggaagaaccgtatctgctacctccaagaaatattctcgaacgaaatggctaaagtcgatgattctttcttccatcgtctcgaagaatctttcctcgtcgaagaagataagaagcatgaacgtcatcctatcttcggtaacatcgtcgatgaagtcgcttaccatgaaaagtaccctaccatctaccatctccgtaagaagctcgtcgattctaccgataaggctgatctccgtctcatctacctcgctctcgctcatatgatcaagttccgtggtcatttcctcatcgaaggtgatctcaaccctgataactctgatgtcgataagctcttcatccaactcgtccaaacctacaaccaactcttcgaagaaaaccctatcaacgcttctggtgtcgatgctaaggctatcctctctgctcgtctctctaagtctcgtcgtctcgaaaacctcatcgctcaactccctggtgaaaagaagaacggcctcttcggtaacctcatcgctctctctctcggcctcacccctaacttcaagtctaacttcgatctcgctgaagatgctaagctccaactctctaaggatacctacgatgatgatctcgataacctcctcgctcaaatcggtgatcaatacgctgatctcttcctcgctgctaagaacctctctgatgctatcctcctctctgatatcctccgtgtcaacaccgaaatcaccaaggctcctctctctgcttctatgatcaagcgttacgatgaacatcatcaagatctcaccctcctcaaggctctcgtccgtcaacaactccctgaaaagtacaaggaaatcttcttcgatcaatctaagaacggttacgctggttacatcgatggtggtgcttctcaagaagaattctacaagttcatcaagcctatcctcgaaaagatggatggtaccgaagaactcctcgtcaagctcaaccgtgaagatctcctccgtaagcaacgtaccttcgataacggttctatccctcatcaaatccatctcggtgaactccatgctatcctccgtcgtcaagaagatttctaccctttcctcaaggataaccgtgaaaagatcgaaaagatcctcaccttccgtatcccttactacgtcggtcctctcgctcgtggtaactctcgtttcgcttggatgacccgtaagtctgaagaaaccatcaccccttggaacttcgaagaagtcgtcgataagggtgcttctgctcaatctttcatcgaacgtatgaccaacttcgataagaacctccctaacgaaaaggtcctccctaagcattctctcctctacgaatacttcaccgtctacaacgaactcaccaaggtcaagtacgtcaccgaaggtatgcgtaagcctgctttcctctctggtgaacaaaagaaggctatcgtcgatctcctcttcaagaccaaccgtaaggtcaccgtcaagcaactcaaggaagattacttcaagaagatcgaatgcttcgattctgtcgaaatctctggtgtcgaagatcgtttcaacgcttctctcggtacctaccatgatctcctcaagatcatcaaggataaggatttcctcgataacgaagaaaacgaagatatcctcgaagatatcgtcctcaccctcaccctcttcgaagatcgtgaaatgatcgaagaacgtctcaagacctacgctcatctcttcgatgataaggtcatgaagcaactcaagcgtcgtcgttacaccggttggggtcgtctctctcgtaagctcatcaacggtatccgtgataagcaatctggcaagaccatcctggactttctgaagtctgatggtttcgcgaaccgtaacttcatgcaactcatccacgacgattcgctaacgttcaaagaagatatccaaaaggctcaagtctctggtcaaggtgattctctccatgaacatatcgctaacctcgctggttctcctgctatcaagaagggtatcctccaaaccgtcaaggtcgtcgatgaactcgtcaaggtcatgggtcgtcataagcctgaaaacatcgtcatcgaaatggctcgtgaaaaccaaaccacccaaaagggtcaaaagaactctcgtgaacgtatgaagcgtatcgaagaaggtatcaaggaactcggttctcaaatcctcaaggaacatcctgtcgaaaacacccaactccaaaacgaaaagctctacctctactacctccaaaacggtcgtgatatgtacgtcgatcaagaactcgatatcaaccgtctatcggattacgatgtcgatcatatcgtgccacaatcgttcctcaaagatgattctatcgataacaaggtcctcacccgttctgataagaaccgtggtaagtctgataacgtcccttctgaagaagtcgtcaagaagatgaagaactactggcgtcaactcctcaacgctaagctcatcacccaacgtaagttcgataacctcaccaaggctgaacgtggtggcctctctgaactcgataaggctggtttcatcaagcgtcaactcgtcgaaacccgtcaaatcaccaagcatgtcgctcaaatcctcgattctcgtatgaacaccaagtacgatgaaaacgataagctcatccgtgaagtcaaggtcatcaccctcaagtctaagctcgtctctgatttccgtaaggatttccaattctacaaggtccgtgaaatcaacaactaccatcatgctcacgacgcttacctcaacgctgtcgtcggtacggcactgatcaaaaagtaccctaagctcgaatctgaattcgtctacggtgattacaaggtctacgatgtccgtaagatgatcgctaagtctgaacaagaaatcggcaaggctacggctaagtacttcttctactcgaacatcatgaacttcttcaaaaccgaaatcaccctcgctaacggtgaaatccgtaagcgtcctctcatcgaaaccaacggtgaaaccggtgaaatcgtctgggataagggtcgtgatttcgctaccgtccgtaaggtcctctctatgcctcaagtcaacatcgtcaagaagaccgaagtccaaaccggtggtttctctaaggaatctatcctccctaagcgtaactctgataagctcatcgctcgtaagaaggattgggatcctaagaagtacggtggtttcgattctcctaccgtcgcttactctgtcctcgtcgtcgctaaggtcgaaaagggtaagtctaagaagctcaagtctgtcaaggaactcctcggtatcaccatcatggaacgttcttctttcgaaaagaaccctatcgatttcctcgaagctaagggttacaaggaagtcaagaaggatctcatcatcaagctccctaagtactctctcttcgaactcgaaaacggtcgtaagcgtatgctcgcttctgctggtgaactccaaaagggtaacgaactcgctctcccttctaaatacgtcaacttcctgtacctggcttcgcattacgaaaagctcaagggttcgccagaggataacgaacaaaagcaactcttcgtcgaacaacataagcattacctcgatgaaatcatcgaacaaatctctgaattctctaagcgtgtcatcctcgctgatgctaacctcgataaggtcctctctgcttacaacaagcatcgtgataagcctatccgtgaacaagctgaaaacatcatccatctcttcaccctcaccaacctcggtgctcctgctgctttcaagtacttcgataccaccatcgatcgtaagcgttacacctctaccaaggaagtcctcgatgctaccctcatccatcaatctatcaccggcctctacgaaacccgtatcgatctctctcaactcggtggtgatggtatccatggtgtccctgctgctcctaagaagaagcgtaagcctaagaagaagcgtaagcctaagaagaagcgtaagtaaagtagatgccgaccggatctgtcgatcgacaagctcgagcggccgcagtagatgccgaccgggatccacttaacgttactgaaatcatcaaacagcttgacgaatctggatataagatcgttggtgtcgatgtcagctccggagttgagacaaatggtgttcaggatctcgataagatacgttcatttgtccaagcagcaaagagtgccttctagtgatttaatagctccatgtcaacaagaataaaacgcgtttcgggtttacctcttccagatacagctcatctgcaatgcattaatgcattggacctcgcaaccctagtacgcccttcaggctccggcgaagcagaagaatagcttagcagagtctattttcattttcgggagacgagatcaagcagatcaacggtcgtcaagagacctacgagactgaggaatccgctcttggctccacgcgactatatatttgtctctaattgtactttgacatgctcctcttctttactctgatagcttgactatgaaaattccgtcaccagcccctgggttcgcaaagataattgcactgtttcttccttgaactctcaagcctacaggacacacattcatcgtaggtataaacctcgaaaatcattcctactaagatgggtatacaatagtaaccatgcatggttgcctagtgaatgctccgtaacacccaatacgccggccgaaacttttttacaactctcctatgagtcgtttacccagaatgcacaggtacacttgtttagaggtaatccttctttctagaagtcctcgtgtactgtgtaagcgcccactccacatctccactcgagctagctag

SEQ ID NO: 644 - DNA, 13096 bp, synthetic construct
  source 1..13096: mol_type = other DNA
gatccatgccgcctaagaagaaacgcaaggttgaggataagaagtacagcatcggactcgacatcggtactaactcggtaggatgggcagtcatcacggatgaatacaaggttccttccaagaagtttaaggtccttggtaacaccgaccgccattctatcaagaagaacctcattggcgctttgctctttgactcaggagaaaccgctgaggcgacacgcctcaaacgcacggcacgtcgacgttatacacgcagaaagaatcgtatctgctatctgcaggaaatcttttcgaacgaaatggcaaaagttgatgacagcttcttccatcgcctggaggaatcgtttctcgtggaggaggacaagaagcacgagagacatcctatcttcggcaacattgtcgatgaggtcgcttaccacgagaagtaccctactatctaccaccttagaaagaagctcgtagactcaactgacaaagcggatcttcgtctgatctatttggctcttgcccacatgatcaagttccgtggtcattttctcatcgaaggcgaccttaatcccgacaactcggacgtcgataagctgtttatccagctcgtacagacatacaaccagctcttcgaagaaaacccaattaatgcttccggtgttgatgcaaaagctatcctcagcgcgagattgagcaagagcagacgcctcgaaaacctcatcgcccaattgcctggtgaaaagaagaacggcttgttcggcaatcttattgccctgagccttggcctcactccgaacttcaagtcgaacttcgatcttgcggaagatgccaagctgcaactctccaaggacacgtacgatgatgacttggacaatctccttgcccagattggcgatcaatacgccgatcttttcctcgcggcgaagaacttgtcggacgcaatcttgctctcagacatccttcgcgtcaacactgagatcaccaaagcccctctctctgcctcgatgatcaagcgctatgacgaacaccaccaggatctcacgctccttaaggcattggtgcgtcagcagttgcctgagaagtacaaagagattttctttgatcagtcgaagaacggatacgctggctacatcgacggtggcgcttctcaggaggagttctacaagtttatcaaacccattcttgagaagatggatggcacggaggagctcctcgtcaagctgaatcgcgaggacctcctccgtaagcaacgtacgttcgacaatggctcgattccacaccagattcatctgggcgaactccacgccatcctcaggaggcaggaggacttctatcccttcctcaaggataatcgagagaaaattgagaagatcctcacattccgcatcccctattatgtaggcccactcgctcgcggaaactctcgctttgcctggatgacccgcaagtcggaagaaacaatcaccccgtggaacttcgaagaggtggtggacaagggtgcatctgcgcagtcgtttattgagaggatgacaaactttgataagaacctcccgaatgagaaagtcctgccaaaacattccctcctgtatgaatacttcacggtctataacgaactgacaaaggtgaagtacgtgaccgagggtatgcgtaagcctgcctttctttcgggtgagcagaagaaagctattgtcgacttgttgttcaagaccaaccgcaaggtcactgtcaagcaactgaaggaagattacttcaagaaaatcgagtgttttgattcggtagagatctcgggcgtcgaggacaggttcaacgcctctctcggcacctatcacgatcttctcaagatcatcaaggacaaagactttcttgacaacgaagagaacgaggatattctcgaggacatcgtgctcaccctcactttgttcgaagatcgcgaaatgattgaggaacgtcttaagacatatgctcacttgttcgacgacaaagtgatgaagcagctgaagcgtaggcgatacacaggttggggccgcctctcgcgcaagctgattaacggtatccgcgacaagcaatccggcaagacaatcttggatttccttaagagcgacggttttgctaaccgcaacttcatgcagctcatccacgacgacagccttacgttcaaggaggacatccagaaggcccaggtttccggacaaggtgactctctccatgagcacatcgctaacctggcgggaagccccgcgatcaagaaaggtatcctccagaccgtcaaagttgtggacgagctggtcaaggtaatgggccgacacaaaccggagaacattgttatcgagatggcacgagagaatcagacgacccagaaaggccaaaagaactccagagaacgtatgaaacgaatcgaagagggtatcaaggaactgggatcgcagatcctgaaggagcaccccgttgagaacacgcagctccaaaacgaaaagctgtacctctactacttgcaaaatggtagggatatgtacgtcgaccaggaactggatattaatcgtctgtccgactacgacgttgaccacatcgtgccccaatcgtttctcaaggatgactcgatcgataataaagtacttacgcgctcagacaagaaccgaggtaaatcggacaatgtcccatcggaggaagtcgtgaagaagatgaagaactattggcgccaacttcttaacgcaaagctgatcacccagaggaaattcgacaacctcaccaaagcagaacgcggcggcctctccgagctcgacaaggctggatttatcaagcgtcagctcgtcgaaacgcgtcagattaccaagcacgtcgcacagatcctggatagccgcatgaacacaaagtacgacgaaaacgacaagctcatccgtgaggttaaggtcatcaccttgaagtcgaaactcgtgtcggacttccgcaaagattttcagttctataaagttagagagatcaacaactaccaccatgcgcatgacgcctacctcaatgccgtcgtgggcaccgcacttattaagaaatacccgaagctcgagtccgagtttgtctacggcgattacaaggtatacgacgttcgcaagatgattgccaaatcggagcaggagatcggtaaggccactgccaagtacttcttttactcgaacatcatgaatttcttcaaaacagaaatcaccctcgccaacggcgagattcgcaaacgaccactcatcgagactaacggtgaaacgggagagatcgtctgggataagggccgagactttgctacggttcgaaaggtcctttcgatgcctcaagtgaacatcgtcaagaaaacggaggtccaaaccggtggcttcagcaaggagtcgattctgccgaaacgcaattcggacaaattgattgcacgcaagaaggattgggaccctaagaaatatggcggcttcgattcaccgacagtggcctattcggttctggtcgtcgcgaaagtggagaagggcaagtcaaagaagctcaagtcagtgaaggagctcctgggaatcaccatcatggaacgttcctcttttgagaagaaccctatcgactttctcgaggctaagggctacaaagaggtcaagaaagatctcatcatcaaactcccaaaatactcacttttcgagctcgagaacggccgtaaacgaatgctggcgagcgcaggagagcttcaaaagggaaatgaactggctttgccctccaagtacgtcaacttcctctacctcgcaagccattatgagaagttgaagggtagccccgaggacaacgaacaaaagcagctcttcgtggagcaacacaaacattacctggatgaaatcatcgagcaaatctcggagtttagcaagcgagtgatcttggctgatgccaacctcgacaaggtgttgtctgcctacaacaagcatcgagataagccgattcgcgagcaggccgagaacatcatccacctcttcactctcactaacttgggtgcgcctgcggcgtttaaatactttgacacgaccatcgaccgcaagcgttacacaagcacgaaggaagtcctcgacgctacactgatccatcagtcgatcaccggtctgtacgaaacccgcatcgatctgtctcaactgggcggtgacagcggcggctacccatacgatgtgcccgattacgctagcggcggaaagcgtcccgcagccactaagaaggctggacaggccaagaagaagaagtgagcggccgcccggctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccgatgataagctgtcaaacatgagaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggcggccgcacgctaagtggagttgtccgagtccccgaatcacaagaattaggctcgtgctctgtgagatctctcgcgaaacccagatgaaggaaaaaaatcggaagatcgcggaagaagtggggttcgcatggtctaacattgtcgcattcctcacagtttcggctggaaacggcagggacaatcacgagaaatgcgcgacgagtattcagttgtccaaaattatgtcagcttgaaagttggaaacggcggaagaaaattcgtcaggagggcgttgcggctagggtgaagaacggagacaatttcggctttgaaattggctcgactctgattggatcatgacgcactgctggtccacaaccgtgtcgaaggtgccgtctttactacaggtccgctggaagcaaaatggaaaaagccgctggagcccgactacagagccgccgtgttttggtaatcagtcggcaaataggtcagcacagcgcagcgtgacaggttcttgcaatttacagcacagctcgtccgtctacgactttgcacaccacaaagtgtgcggggagcaaaggagccgatcttggtcgcgcgcaaagccaaggagtcttgaacctgagagtgtgcgtgtcttgtgacgcttgcccttctgtactttgctgtgacactaccaccacatctgtcttggctttttgttcatacatccacaccgaccatgtcgctattcaacgtcagcaacggtcttcgtaccgctctccgaccttctgttgccagctcttcgcgcgttgctgccttttccacaaccgccgctgcccgtctcgccacacccacctctgacaacgttggcagttcgggcaagcctcagcacttgaagcagttcaagatctaccgatggaaccctgacaagccctcggagaagcctcgtctgcagtcgtacacactggacctcaaccagaccggtccaatggttctcgacgcgctcatcaaaatcaagaacgaaattgaccctacgctcaccttccgtcgctcgtgccgtgagggtatctgcggttcgtgcgctatgaatattgacggtgtcaacaccctcgcctgcctctgccggatcgacaagcagaatgacaccaagatctaccccttgccgcacatgtacattgtcaaggacctcgtgccagacttgacccagttctacaagcagtaccgatccatcgagcctttcctcaagtccaacaacaccccttctgagggtgaacatcttcagtcgcccgaggagcgtcgtcgactcgacggtctgtacgagtgcattctgtgcgcgtgctgctccacatcctgcccctcttactggtggaatcaggacgagtaccttggccccgccgtgctcatgcaggcgtaccgatggatggccgactcgcgtgacgactttggtgaggagcgaagacagaagctcgagaacaccttttcgctctaccgatgccttaccatcatgaactgctccaggacctgccccaagaacctcaaccctggtaaggcaattgcacagatcaagaaggacatggccgtcggcgcacccaaggcttccgagcgccctatcatggcttcgtcgtaatcttgatatatcatatcgttctttcctcagcacttcttttgtcaatttcaaaagtatctaattgcattcaactccgcttgtggtttgttgttcagtgagagtggaaacgctacgggcaagatgagggcagtgttctggcgacggaaaagtgtgcaagtgtctggcctgcgtcctcgctggttccagcagccgatgcaggacgtgtacctagcgatttcttcgacagcctattgtggcagccgcgattcgccacaatcgtacgtgcggccgccaggtggcacttttcggggaaatgtgcgcggaacccctatttgtttatttttctaaatacattcaaatatgtatccgctcatgagacaataaccctgataaatgcttcaataatattaccgatcctcgatctttgtgcaagctagcccgcctcggcagcaacaaagcagccgagcaagaagcagtacttgccttctgaatcgtgaatgggttacgttcttcaccgctgtgatcagcgaatcatgaatcaaatcatgagggcattgctgatcatgaatcaaatcatgagggcatttaaaaattcagtctgagtcgtgagtagcaagtcggttctggatcggatggcattcatgaatcacagggtcgtgaatcatgaatgttcaagtccccttttctcgagaggctggtgggatcggtgcgaatcacgaatcatgattgtaattcattgagtgaaggagtttcgcagccacccacagtactagaatcacgaatgacaatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcaagctttaatacgttcgttccgatgtagctcaggaacgggcgcagaggcggatgaattggttgcggtggctatggatggtggaggtgaacggcgacgtgcagcgtcggtcacagaggatcggatggggcctgtcgggatgacctgtactataacgagggaggagggggagggaggaggggaaagaggaatgtggggaaggcacgttaccaaggttttgccaagaggctcttgtgttattccggaggtgtagccgaatgggcgatccgagctaacgccagctgggcgtgagaagcagttggtctgaaagcggaggcggtgcaagacggttctaagaaggaggcgaataagaagtgttttgtgtgctgcgggtgcgaatagacggtcacgagtggatggaagccgacttgtaggcgtgctgaaagacgtcgtgcgggtgcggttttggttttgtgttggtcttggtaaaagtgtgccgcaggtgagggttcttgattggtgaacgtgaaaacggatggccaagtccgagtcgaccagagagagaggcagagagagagagagagatggctcttcagcgccgcttcgcgcgtccttcacgattattcgtgattactgtccaccggtccctcttactcagaactgccggaacgaattcgtgatttacaccaaacacgcgctgtcacagtcacgagtccatgagccgtgagccccgcttcagatcctgttttctcttattcagcgtaacaacacaaaacagaatttcttctaaacacccttgcaattcgcgcacacccctgtagcagtctgtcagcattcaaaattccattctacaacggtacccgtaccgagctcgactttcacttttctctatcactgatagggagtggtaaactcgactttcattttctctatcactgatagggagtggtaaactcgactttcacttttctctatcactgatagggagtggtaaactcgactttcacttttctctatcacggatagggagtggtaaactcgactttcacttttctctatcactgatagggagtggtaaactcgactttcacttttctctatcactgatagggagtggtaaactcgactttcacttttctctatcactgatagggagtggtaaactcgagtaccgagctcgactttcacttttctctatcactgatagggagtggtaaactcgactttcattttctctatcactgatagggagtggtaaactcgactttcacttttctctatcactgatagggagtggtaaactcgactttcacttttctctatcacggatagggagtggtaaactcgactttcacttttctctatcactgatagggagtggtaaactcgactttcacttttctctatcactgatagggagtggtaaactcgactttcacttttctctatcactgatagggagtggtaaactcgaggggatcaattcgaccaatgaggcgcgagacgaggggacgctggaagttgaggcgcaagaaaatttttctctggttctgcgcggcagagacgaccagattcgcccgctttcttctgcgttgggtgcctcttttgggtgccagactttgtgtgtgcgccagcgagacgttccaataaagggcgctgtctcggcactatctttctttctttcctcatacatcgtatcataccatacacagacaacatcatccacgg

SEQ ID NO: 645-647 - skipped (3 entries)

SEQ ID NO: 648 - DNA, 383 bp, synthetic construct
  source 1..383: mol_type = other DNA
attaccgatcctcgatctttgtgcaagctagcccgcctcggcagcaacaaagcagccgagcaagaagcagtacttgccttctgaatcgtgaatgggttacgttcttcaccgctgtgatcagcgaatcatgaatcaaatcatgagggcattgctgatcatgaatcaaatcatgagggcatttaaaaattcagtctgagtcgtgagtagcaagtcggttctggatcggatggcattcatgaatcacagggtcgtgaatcatgaatgttcaagtccccttttctcgagaggctggtgggatcggtgcgaatcacgaatcatgattgtaattcattgagtgaaggagtttcgcagccacccacagtactagaatcacgaatgacaat

SEQ ID NO: 649-654 - skipped (6 entries)

SEQ ID NO: 655 - DNA, 11818 bp, synthetic construct
  source 1..11818: mol_type = other DNA
gatccatgccgcctaagaagaaacgcaaggttgaggataagaagtacagcatcggactcgacatcggtactaactcggtaggatgggcagtcatcacggatgaatacaaggttccttccaagaagtttaaggtccttggtaacaccgacagacattctatcaagaagaacctcattggcgctttgctctttgactcaggagaaaccgctgaggcgacacgcctcaaacgcacggcacgtcgacgttatacacgcagaaagaatcgtatctgctatctgcaggaaatcttttcgaacgaaatggcaaaagttgatgacagcttcttccatcgcctggaggaatcgtttctcgtggaggaggacaagaagcacgagagacatcctatcttcggcaacattgtcgatgaggtcgcttaccacgagaagtaccctactatctaccaccttagaaagaagctcgtagactcaactgacaaagcggatcttcgtctgatctatttggctcttgcccacatgatcaagttccgtggtcattttctcatcgaaggcgaccttaatcccgacaactcggacgtcgataagctgtttatccagctcgtacagacatacaaccagctcttcgaagaaaacccaattaatgcttccggtgttgatgcaaaagctatcctcagcgcgagattgagcaagagcagacgcctcgaaaacctcatcgcccaattgcctggtgaaaagaagaacggcttgttcggcaatcttattgccctgagccttggcctcactccgaacttcaagtcgaacttcgatcttgcggaagatgccaagctgcaactctccaaggacacgtacgatgatgacttggacaatctccttgcccagattggcgatcaatacgccgatcttttcctcgcggcgaagaacttgtcggacgcaatcttgctctcagacatccttcgcgtcaacactgagatcaccaaagcccctctctctgcctcgatgatcaagcgctatgacgaacaccaccaggatctcacgctccttaaggcattggtgcgtcagcagttgcctgagaagtacaaagagattttctttgatcagtcgaagaacggatacgctggctacatcgacggtggcgcttctcaggaggagttctacaagtttatcaaacccattcttgagaagatggatggcacggaggagctcctcgtcaagctgaatcgcgaggacctcctccgtaagcaacgtacgttcgacaatggctcgattccacaccagattcatctgggcgaactccacgccatcctcaggaggcaggaggacttctatcccttcctcaaggataatcgagagaaaattgagaagatcctcacattccgcatcccctattatgtaggcccactcgctcgcggaaactctcgctttgcctggatgacccgcaagtcggaagaaacaatcaccccgtggaacttcgaagaggtggtggacaagggtgcatctgcgcagtcgtttattgagaggatgacaaactttgataagaacctcccgaatgagaaagtcctgccaaaacattccctcctgtatgaatacttcacggtctataacgaactgacaaaggtgaagtacgtgaccgagggtatgcgtaagcctgcctttctttcgggtgagcagaagaaagctattgtcgacttgttgttcaagaccaaccgcaaggtcactgtcaagcaactgaaggaagattacttcaagaaaatcgagtgttttgattcggtagagatctcgggcgtcgaggacaggttcaacgcctctctcggcacctatcacgatcttctcaagatcatcaaggacaaagactttcttgacaacgaagagaacgaggatattctcgaggacatcgtgctcaccctcactttgttcgaagatcgcgaaatgattgaggaacgtcttaagacatatgctcacttgttcgacgacaaagtgatgaagcagctgaagcgtaggcgatacacaggttggggccgcctctcgcgcaagctgattaacggtatccgcgacaagcaatccggcaagacaatcttggatttccttaagagcgacggttttgctaaccgcaacttcatgcagctcatccacgacgacagccttacgttcaaggaggacatccagaaggcccaggtttccggacaaggtgactctctccatgagcacatcgctaacctggcgggaagccccgcgatcaagaaaggtatcctccagaccgtcaaagttgtggacgagctggtcaaggtaatgggccgacacaaaccggagaacattgttatcgagatggcacgagagaatcagacgacccagaaaggccaaaagaactccagagaacgtatgaaacgaatcgaagagggtatcaaggaactgggatcgcagatcctgaaggagcaccccgttgagaacacgcagctccaaaacgaaaagctgtacctctactacttgcaaaatggtagggatatgtacgtcgaccaggaactggatattaatcgtctgtccgactacgacgttgaccacatcgtgccccaatcgtttctcaaggatgactcgatcgataataaagtacttacgcgctcagacaagaaccgaggtaaatcggacaatgtcccatcggaggaagtcgtgaagaagatgaagaactattggcgccaacttcttaacgcaaagctgatcacccagaggaaattcgacaacctcaccaaagcagaacgcggcggcctctccgagctcgacaaggctggatttatcaagcgtcagctcgtcgaaacgcgtcagattaccaagcacgtcgcacagatcctggatagccgcatgaacacaaagtacgacgaaaacgacaagctcatccgtgaggttaaggtcatcaccttgaagtcgaaactcgtgtcggacttccgcaaagattttcagttctataaagttagagagatcaacaactaccaccatgcgcatgacgcctacctcaatgccgtcgtgggcaccgcacttattaagaaatacccgaagctcgagtccgagtttgtctacggcgattacaaggtatacgacgttcgcaagatgattgccaaatcggagcaggagatcggtaaggccactgccaagtacttcttttactcgaacatcatgaatttcttcaaaacagaaatcaccctcgccaacggcgagattcgcaaacgaccactcatcgagactaacggtgaaacgggagagatcgtctgggataagggccgagactttgctacggttcgaaaggtcctttcgatgcctcaagtgaacatcgtcaagaaaacggaggtccaaaccggtggcttcagcaaggagtcgattctgccgaaacgcaattcggacaaattgattgcacgcaagaaggattgggaccctaagaaatatggcggcttcgattcaccgacagtggcctattcggttctggtcgtcgcgaaagtggagaagggcaagtcaaagaagctcaagtcagtgaaggagctcctgggaatcaccatcatggaacgttcctcttttgagaagaaccctatcgactttctcgaggctaagggctacaaagaggtcaagaaagatctcatcatcaaactcccaaaatactcacttttcgagctcgagaacggccgtaaacgaatgctggcgagcgcaggagagcttcaaaagggaaatgaactggctttgccctccaagtacgtcaacttcctctacctcgcaagccattatgagaagttgaagggtagccccgaggacaacgaacaaaagcagctcttcgtggagcaacacaaacattacctggatgaaatcatcgagcaaatctcggagtttagcaagcgagtgatcttggctgatgccaacctcgacaaggtgttgtctgcctacaacaagcatcgagataagccgattcgcgagcaggccgagaacatcatccacctcttcactctcactaacttgggtgcgcctgcggcgtttaaatactttgacacgaccatcgaccgcaagcgttacacaagcacgaaggaagtcctcgacgctacactgatccatcagtcgatcaccggtctgtacgaaacccgcatcgatctgtctcaactgggtggtgactcgggtggctacccatacgatgtgcccgattacgctagcggcggaaagcgtcccgcagccactaagaaggctggacaggccaagaagaagaagtgagcggccgcccggctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccgatgataagctgtcaaacatgagaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctattggtaccaccttgagaccgaattcgcttactaaaagccagataacagtatgcgtatttgcgcgctgatttttgcggtataagaatatatactgatatgtatacccgaagtatgtcaaaaagaggtgtgctaagcttaggaggtcagctatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaagagctcaggaggacagctatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccagtggtgcatatcggggatgaaagctggcgcatgatgaccaccgatatggccagtgtgccagtctccgttatcggggaagaagtggctgatctcagccaccgcgaaaatgacatcaaaaacgccattaacctgatgttctggggaatataaactagtaggaggtaatcaatgctggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatgatcatctggcggacctcttcggaggtccgcttttttttctcgagggtctcagtattctagtttcggggaaatgtgcgcggaacccctatttgtttatttttctaaatacattcaaatatgtatccgctcatgagacaataaccctgataaatgcttcaataatattaccgatcctcgatctttgtgcaagctagcccgcctcggcagcaacaaagcagccgagcaagaagcagtacttgccttctgaatcgtgaatgggttacgttcttcaccgctgtgatcagcgaatcatgaatcaaatcatgagggcattgctgatcatgaatcaaatcatgagggcatttaaaaattcagtctgagtcgtgagtagcaagtcggttctggatcggatggcattcatgaatcacagggtcgtgaatcatgaatgttcaagtccccttttctcgagaggctggtgggatcggtgcgaatcacgaatcatgattgtaattcattgagtgaaggagtttcgcagccacccacagtactagaatcacgaatgacaatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtcacgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccactatgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcagcttggtacccgtaccgagctcgactttcacttttctctatcactgatagggagtggtaaactcgactttcattttctctatcactgatagggagtggtaaactcgactttcacttttctctatcactgatagggagtggtaaactcgactttcacttttctctatcacggatagggagtggtaaactcgactttcacttttctctatcactgatagggagtggtaaactcgactttcacttttctctatcactgatagggagtggtaaactcgactttcacttttctctatcactgatagggagtggtaaactcgagtaccgagctcgactttcacttttctctatcactgatagggagtggtaaactcgactttcattttctctatcactgatagggagtggtaaactcgactttcacttttctctatcactgatagggagtggtaaactcgactttcacttttctctatcacggatagggagtggtaaactcgactttcacttttctctatcactgatagggagtggtaaactcgactttcacttttctctatcactgatagggagtggtaaactcgactttcacttttctctatcactgatagggagtggtaaactcgaggggatcaattcgaccaatgaggcgcgagacgaggggacgctggaagttgaggcgcaagaaaatttttctctggttctgcgcggcagagacgaccagattcgcccgctttcttctgcgttgggtgcctcttttgggtgccagactttgtgtgtgcgccagcgagacgttccaataaagggcgctgtctcggcactatctttctttctttcctcatacatcgtatcataccatacacagacaacatcatccacgg

SEQ ID NO: 656 - DNA, 7890 bp, synthetic construct
  source 1..7890: mol_type = other DNA
gacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggatctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcaggcctctgcagtcgacgggcccgggatccgataacaggtctcatagttgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatggataagaagtactctatcggcctcgatatcggtaccaactctgtcggttgggctgtcatcaccgatgaatacaaggtcccttctaagaagttcaaggtcctcggtaacaccgatcgtcattctatcaagaagaacctcatcggtgctctcctcttcgattctggtgaaaccgctgaagctacccgtctcaagcgtaccgctcgtcgtcgttacacccgtcgtaagaaccgtatctgctacctccaagaaatcttctctaacgaaatggctaaggtcgatgattctttcttccatcgtctcgaagaatctttcctcgtcgaagaagataagaagcatgaacgtcatcctatcttcggtaacatcgtcgatgaagtcgcttaccatgaaaagtaccctaccatctaccatctccgtaagaagctcgtcgattctaccgataaggctgatctccgtctcatctacctcgctctcgctcatatgatcaagttccgtggtcatttcctcatcgaaggtgatctcaaccctgataactctgatgtcgataagctcttcatccaactcgtccaaacctacaaccaactcttcgaagaaaaccctatcaacgcttctggtgtcgatgctaaggctatcctctctgctcgtctctctaagtctcgtcgtctcgaaaacctcatcgctcaactccctggtgaaaagaagaacggcctcttcggtaacctcatcgctctctctctcggcctcacccctaacttcaagtctaacttcgatctcgctgaagatgctaagctccaactctctaaggatacctacgatgatgatctcgataacctcctcgctcaaatcggtgatcaatacgctgatctcttcctcgctgctaagaacctctctgatgctatcctcctctctgatatcctccgtgtcaacaccgaaatcaccaaggctcctctctctgcttctatgatcaagcgttacgatgaacatcatcaagatctcaccctcctcaaggctctcgtccgtcaacaactccctgaaaagtacaaggaaatcttcttcgatcaatctaagaacggttacgctggttacatcgatggtggtgcttctcaagaagaattctacaagttcatcaagcctatcctcgaaaagatggatggtaccgaagaactcctcgtcaagctcaaccgtgaagatctcctccgtaagcaacgtaccttcgataacggttctatccctcatcaaatccatctcggtgaactccatgctatcctccgtcgtcaagaagatttctaccctttcctcaaggataaccgtgaaaagatcgaaaagatcctcaccttccgtatcccttactacgtcggtcctctcgctcgtggtaactctcgtttcgcttggatgacccgtaagtctgaagaaaccatcaccccttggaacttcgaagaagtcgtcgataagggtgcttctgctcaatctttcatcgaacgtatgaccaacttcgataagaacctccctaacgaaaaggtcctccctaagcattctctcctctacgaatacttcaccgtctacaacgaactcaccaaggtcaagtacgtcaccgaaggtatgcgtaagcctgctttcctctctggtgaacaaaagaaggctatcgtcgatctcctcttcaagaccaaccgtaaggtcaccgtcaagcaactcaaggaagattacttcaagaagatcgaatgcttcgattctgtcgaaatctctggtgtcgaagatcgtttcaacgcttctctcggtacctaccatgatctcctcaagatcatcaaggataaggatttcctcgataacgaagaaaacgaagatatcctcgaagatatcgtcctcaccctcaccctcttcgaagatcgtgaaatgatcgaagaacgtctcaagacctacgctcatctcttcgatgataaggtcatgaagcaactcaagcgtcgtcgttacaccggttggggtcgtctctctcgtaagctcatcaacggtatccgtgataagcaatctggtaagaccatcctcgatttcctcaagtctgatggtttcgctaaccgtaacttcatgcaactcatccatgatgattctctcaccttcaaggaagatatccaaaaggctcaagtctctggtcaaggtgattctctccatgaacatatcgctaacctcgctggttctcctgctatcaagaagggtatcctccaaaccgtcaaggtcgtcgatgaactcgtcaaggtcatgggtcgtcataagcctgaaaacatcgtcatcgaaatggctcgtgaaaaccaaaccacccaaaagggtcaaaagaactctcgtgaacgtatgaagcgtatcgaagaaggtatcaaggaactcggttctcaaatcctcaaggaacatcctgtcgaaaacacccaactccaaaacgaaaagctctacctctactacctccaaaacggtcgtgatatgtacgtcgatcaagaactcgatatcaaccgtctctctgattacgatgtcgatcatatcgtccctcaatctttcctcaaggatgattctatcgataacaaggtcctcacccgttctgataagaaccgtggtaagtctgataacgtcccttctgaagaagtcgtcaagaagatgaagaactactggcgtcaactcctcaacgctaagctcatcacccaacgtaagttcgataacctcaccaaggctgaacgtggtggcctctctgaactcgataaggctggtttcatcaagcgtcaactcgtcgaaacccgtcaaatcaccaagcatgtcgctcaaatcctcgattctcgtatgaacaccaagtacgatgaaaacgataagctcatccgtgaagtcaaggtcatcaccctcaagtctaagctcgtctctgatttccgtaaggatttccaattctacaaggtccgtgaaatcaacaactaccatcatgctcatgatgcttacctcaacgctgtcgtcggtaccgctctcatcaagaagtaccctaagctcgaatctgaattcgtctacggtgattacaaggtctacgatgtccgtaagatgatcgctaagtctgaacaagaaatcggtaaggctaccgctaagtacttcttctactctaacatcatgaacttcttcaagaccgaaatcaccctcgctaacggtgaaatccgtaagcgtcctctcatcgaaaccaacggtgaaaccggtgaaatcgtctgggataagggtcgtgatttcgctaccgtccgtaaggtcctctctatgcctcaagtcaacatcgtcaagaagaccgaagtccaaaccggtggtttctctaaggaatctatcctccctaagcgtaactctgataagctcatcgctcgtaagaaggattgggatcctaagaagtacggtggtttcgattctcctaccgtcgcttactctgtcctcgtcgtcgctaaggtcgaaaagggtaagtctaagaagctcaagtctgtcaaggaactcctcggtatcaccatcatggaacgttcttctttcgaaaagaaccctatcgatttcctcgaagctaagggttacaaggaagtcaagaaggatctcatcatcaagctccctaagtactctctcttcgaactcgaaaacggtcgtaagcgtatgctcgcttctgctggtgaactccaaaagggtaacgaactcgctctcccttctaagtacgtcaacttcctctacctcgcttctcattacgaaaagctcaagggttctcctgaagataacgaacaaaagcaactcttcgtcgaacaacataagcattacctcgatgaaatcatcgaacaaatctctgaattctctaagcgtgtcatcctcgctgatgctaacctcgataaggtcctctctgcttacaacaagcatcgtgataagcctatccgtgaacaagctgaaaacatcatccatctcttcaccctcaccaacctcggtgctcctgctgctttcaagtacttcgataccaccatcgatcgtaagcgttacacctctaccaaggaagtcctcgatgctaccctcatccatcaatctatcaccggcctctacgaaacccgtatcgatctctctcaactcggtggtgatggtatccatggtgtccctgctgctcctaagaagaagcgtaagcctaagaagaagcgtaagcctaagaagaagcgtaagtaaagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcgagctcgcagtgagacctgttatctagatgcattcgcgaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 657 - DNA, 7771 bp, synthetic construct
  source 1..7771: mol_type = other DNA
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataacaggtctcaaacaatggataagaagtactctatcggcctcgatatcggtaccaactctgtcggttgggctgtcatcaccgatgaatacaaggtcccttctaagaagttcaaggtcctcggtaacaccgatcgtcattctatcaagaagaacctcatcggtgctctcctcttcgattctggtgaaaccgctgaagctacccgtctcaagcgtaccgctcgtcgtcgttacacccgtcggaagaaccgtatctgctacctccaagaaatattctcgaacgaaatggctaaagtcgatgattctttcttccatcgtctcgaagaatctttcctcgtcgaagaagataagaagcatgaacgtcatcctatcttcggtaacatcgtcgatgaagtcgcttaccatgaaaagtaccctaccatctaccatctccgtaagaagctcgtcgattctaccgataaggctgatctccgtctcatctacctcgctctcgctcatatgatcaagttccgtggtcatttcctcatcgaaggtgatctcaaccctgataactctgatgtcgataagctcttcatccaactcgtccaaacctacaaccaactcttcgaagaaaaccctatcaacgcttctggtgtcgatgctaaggctatcctctctgctcgtctctctaagtctcgtcgtctcgaaaacctcatcgctcaactccctggtgaaaagaagaacggcctcttcggtaacctcatcgctctctctctcggcctcacccctaacttcaagtctaacttcgatctcgctgaagatgctaagctccaactctctaaggatacctacgatgatgatctcgataacctcctcgctcaaatcggtgatcaatacgctgatctcttcctcgctgctaagaacctctctgatgctatcctcctctctgatatcctccgtgtcaacaccgaaatcaccaaggctcctctctctgcttctatgatcaagcgttacgatgaacatcatcaagatctcaccctcctcaaggctctcgtccgtcaacaactccctgaaaagtacaaggaaatcttcttcgatcaatctaagaacggttacgctggttacatcgatggtggtgcttctcaagaagaattctacaagttcatcaagcctatcctcgaaaagatggatggtaccgaagaactcctcgtcaagctcaaccgtgaagatctcctccgtaagcaacgtaccttcgataacggttctatccctcatcaaatccatctcggtgaactccatgctatcctccgtcgtcaagaagatttctaccctttcctcaaggataaccgtgaaaagatcgaaaagatcctcaccttccgtatcccttactacgtcggtcctctcgctcgtggtaactctcgtttcgcttggatgacccgtaagtctgaagaaaccatcaccccttggaacttcgaagaagtcgtcgataagggtgcttctgctcaatctttcatcgaacgtatgaccaacttcgataagaacctccctaacgaaaaggtcctccctaagcattctctcctctacgaatacttcaccgtctacaacgaactcaccaaggtcaagtacgtcaccgaaggtatgcgtaagcctgctttcctctctggtgaacaaaagaaggctatcgtcgatctcctcttcaagaccaaccgtaaggtcaccgtcaagcaactcaaggaagattacttcaagaagatcgaatgcttcgattctgtcgaaatctctggtgtcgaagatcgtttcaacgcttctctcggtacctaccatgatctcctcaagatcatcaaggataaggatttcctcgataacgaagaaaacgaagatatcctcgaagatatcgtcctcaccctcaccctcttcgaagatcgtgaaatgatcgaagaacgtctcaagacctacgctcatctcttcgatgataaggtcatgaagcaactcaagcgtcgtcgttacaccggttggggtcgtctctctcgtaagctcatcaacggtatccgtgataagcaatctggcaagaccatcctggactttctgaagtctgatggtttcgcgaaccgtaacttcatgcaactcatccacgacgattcgctaacgttcaaagaagatatccaaaaggctcaagtctctggtcaaggtgattctctccatgaacatatcgctaacctcgctggttctcctgctatcaagaagggtatcctccaaaccgtcaaggtcgtcgatgaactcgtcaaggtcatgggtcgtcataagcctgaaaacatcgtcatcgaaatggctcgtgaaaaccaaaccacccaaaagggtcaaaagaactctcgtgaacgtatgaagcgtatcgaagaaggtatcaaggaactcggttctcaaatcctcaaggaacatcctgtcgaaaacacccaactccaaaacgaaaagctctacctctactacctccaaaacggtcgtgatatgtacgtcgatcaagaactcgatatcaaccgtctatcggattacgatgtcgatcatatcgtgccacaatcgttcctcaaagatgattctatcgataacaaggtcctcacccgttctgataagaaccgtggtaagtctgataacgtcccttctgaagaagtcgtcaagaagatgaagaactactggcgtcaactcctcaacgctaagctcatcacccaacgtaagttcgataacctcaccaaggctgaacgtggtggcctctctgaactcgataaggctggtttcatcaagcgtcaactcgtcgaaacccgtcaaatcaccaagcatgtcgctcaaatcctcgattctcgtatgaacaccaagtacgatgaaaacgataagctcatccgtgaagtcaaggtcatcaccctcaagtctaagctcgtctctgatttccgtaaggatttccaattctacaaggtccgtgaaatcaacaactaccatcatgctcacgacgcttacctcaacgctgtcgtcggtacggcactgatcaaaaagtaccctaagctcgaatctgaattcgtctacggtgattacaaggtctacgatgtccgtaagatgatcgctaagtctgaacaagaaatcggcaaggctacggctaagtacttcttctactcgaacatcatgaacttcttcaaaaccgaaatcaccctcgctaacggtgaaatccgtaagcgtcctctcatcgaaaccaacggtgaaaccggtgaaatcgtctgggataagggtcgtgatttcgctaccgtccgtaaggtcctctctatgcctcaagtcaacatcgtcaagaagaccgaagtccaaaccggtggtttctctaaggaatctatcctccctaagcgtaactctgataagctcatcgctcgtaagaaggattgggatcctaagaagtacggtggtttcgattctcctaccgtcgcttactctgtcctcgtcgtcgctaaggtcgaaaagggtaagtctaagaagctcaagtctgtcaaggaactcctcggtatcaccatcatggaacgttcttctttcgaaaagaaccctatcgatttcctcgaagctaagggttacaaggaagtcaagaaggatctcatcatcaagctccctaagtactctctcttcgaactcgaaaacggtcgtaagcgtatgctcgcttctgctggtgaactccaaaagggtaacgaactcgctctcccttctaaatacgtcaacttcctgtacctggcttcgcattacgaaaagctcaagggttcgccagaggataacgaacaaaagcaactcttcgtcgaacaacataagcattacctcgatgaaatcatcgaacaaatctctgaattctctaagcgtgtcatcctcgctgatgctaacctcgataaggtcctctctgcttacaacaagcatcgtgataagcctatccgtgaacaagctgaaaacatcatccatctcttcaccctcaccaacctcggtgctcctgctgctttcaagtacttcgataccaccatcgatcgtaagcgttacacctctaccaaggaagtcctcgatgctaccctcatccatcaatctatcaccggcctctacgaaacccgtatcgatctctctcaactcggtggtgatggtatccatggtgtccctgctgctcctaagaagaagcgtaagcctaagaagaagcgtaagcctaagaagaagcgtaagtaaagtagatgccgaccggatctgtcgatcgacaagctcgagcggccgcagtagatgccgaccgggatccacttaacgttactgaaatcatcaaacagcttgacgaatctggatataagatcgttggtgtcgatgtcagctccggagttgagacaaatggtgttcaggatctcgataagatacgttcatttgtccaagcagcaaagagtgccttctagtgatttaatagctccatgtcaacaagaataaaacgcgtttcgggtttacctcttccagatacagctcatctgcaatgcattaatgcattggacctcgcaaccctagtacgcccttcaggctccggcgaagcagaagaatagcttagcagagtctattttcattttcgggagacgagatcaagcagatcaacggtcgtcaagagacctacgagactgaggaatccgctcttggctccacgcgactatatatttgtctctaattgtactttgacatgctcctcttctttactctgatagcttgactatgaaaattccgtcaccagcccctgggttcgcaaagataattgcactgtttcttccttgaactctcaagcctacaggacacacattcatcgtaggtataaacctcgaaaatcattcctactaagatgggtatacaatagtaaccatgcatggttgcctagtgaatgctccgtaacacccaatacgccggccgaaacttttttacaactctcctatgagtcgtttacccagaatgcacaggtacacttgtttagaggtaatccttctttctagaagtcctcgtgtactgtgtaagcgcccactccacatctccactcgagctagctagggcttgagacctgttatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagatccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 658-659 - skipped (2 entries)

SEQ ID NO: 660 - DNA, 20 bp, synthetic construct
  source 1..20: mol_type = other DNA
tcacctgcatgatcaagtgt

SEQ ID NO: 661 - DNA, 20 bp, synthetic construct
  source 1..20: mol_type = other DNA
ctcccaacacttgatcatgc

SEQ ID NO: 662 - DNA, 20 bp, synthetic construct
  source 1..20: mol_type = other DNA
cagaaatgagttataaaagt

SEQ ID NO: 663 - DNA, 20 bp, synthetic construct
  source 1..20: mol_type = other DNA
cgaagtcgtcgctgctctaa

SEQ ID NO: 664 - DNA, 67 bp, synthetic construct
  source 1..67: mol_type = other DNA
cacctgggagctgatgagtccgtgaggacgaaacgagtaagctcgtcctcccaacacttgatcatgc

SEQ ID NO: 665 - DNA, 67 bp, synthetic construct
  source 1..67: mol_type = other DNA
aaacgcatgatcaagtgttgggaggacgagcttactcgtttcgtcctcacggactcatcagctccca

SEQ ID NO: 666 - DNA, 1368 bp, synthetic construct
  source 1..1368: mol_type = other DNA
gacgctgtggatcaagcaacgccactcgctcgctccatcgcaggctggtcgcagacaaattaaaaggcggcaaactcgtacagccgcggggttgtccgctgcaaagtacagagtgataaaagccgccatgcgaccatcaacgcgttgatgcccagctttttcgatccgagaatccaccgtagaggcgatagcaagtaaagaaaagctaaacaaaaaaaaatttctgcccctaagccatgaaaacgagatggggtggagcagaaccaaggaaagagtcgcgctgggctgccgttccggaaggtgttgtaaaggctcgacgcccaaggtgggagtctaggagaagaatttgcatcgggagtggggcgggttacccctccatatccaatgacagatatctaccagccaagggtttgagcccgcccgcttagtcgtcgtcctcgcttgcccctccataaaaggatttcccctccccctcccacaaaattttctttcccttcctctccttgtccgcttcagtacgtatatcttcccttccctcgcttctctcctccatccttctttcatccatctcctgctaacttctctgctcagcacctctacgcattactagccgtagtatctgagcacttctcccttttatattccacaaaacataacacaaccttcacctgggagctgatgagtccgtgaggacgaaacgagtaagctcgtcctcccaacacttgatcatgcgttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactgagaaacaggtcggaagccaatggccaggagctccttgtaaaaaaatactccttggtctattaagttgcccattctttagcaggagtgtgcagactatgtccgtatccacatgccgcaactgcagattcataggagctgttggggatattggcataggatcccattgttacgtactatttaatgacaaatacacgatcaatttcaccactattgttcacttctactggtagcttagacgtactatttctcgtggaatagccagtacttgctcttatattggccgtcgcgaatttcggcgtcgacaacgagctaccacatttgttcatgccaggcagctgaggacttgaaagccttgaaatgccgaaggtagtatatcccgcgttcctttatcagattagaacaaatgccgttctatcatctgggtatacttagtccttttgaccggggaaatatgtcacgtgcaaggcgctttggaagcttccgacc

SEQ ID NO: 667 - DNA, 174 bp, synthetic construct
  source 1..174: mol_type = other DNA
actagattcccttacgccttccatcacctgtccgcacccggccccatcccgctttcaaccccccgctccgagccggcaccggagcacacccacccaaaccggttcgatggcgtagttggttatcgcatctgtctaacacacagaaggtcctcagttcgagcctgggtcgaatca

SEQ ID NO: 668 - DNA, 104 bp, synthetic construct
  source 1..104: mol_type = other DNA
gttttagagctagaaatagcaagttaaaataaggctagtccgttatcaacttgaaaaagtggcaccgagtcggtgcttttttatgccacaacactggtggtacc

SEQ ID NO: 669 - DNA, 298 bp, synthetic construct
  source 1..298: mol_type = other DNA
actagattcccttacgccttccatcacctgtccgcacccggccccatcccgctttcaaccccccgctccgagccggcaccggagcacacccacccaaaccggttcgatggcgtagttggttatcgcatctgtctaacacacagaaggtcctcagttcgagcctgggtcgaatcactcccaacacttgatcatgcgttttagagctagaaatagcaagttaaaataaggctagtccgttatcaacttgaaaaagtggcaccgagtcggtgcttttttatgccacaacactggtggtacc

SEQ ID NO: 670 - DNA, 888 bp, synthetic construct
  source 1..888: mol_type = other DNA
actggattaggttgaagaaccggcgatctgggcagacgcgccacgctctgagtacctaagggtgtacttaaactggattaggttgaagaaccggcgatctgggcagacgcgccacgctctgagtacctaagggtgtacttaaatttatcacagcttgacgtttgacctggaagcttgatttacgcaaggttggaacttgcaccccccggtcgagcatctctctctagtcatagtttatctttgtataaatgggggcctcaacgcaaggccgcaaaactactcccaacttttataactcatttctgctcccaacacttgatcagaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgcaggtgatacccgcgtgcaactcggcgtacgtcgtttttattcgctgacttcacccgctaattactataacttgaaaacacagagcaataagatcactatgtcctactcccgagtctttgagaaacatgggatggctctctgtcagcgatgcggtctacagcgagttcataggagagttggctacccgcgcttccaatcgaaattactccaacgagttcggcctcatgcaacctatccaggaattca

SEQ ID NO: 671 - DNA, 35 bp, synthetic construct
  source 1..35: mol_type = other DNA
ctaatgaatattagccagtacgtcgcgtcgaacga

SEQ ID NO: 672 - DNA, 35 bp, synthetic construct
  source 1..35: mol_type = other DNA
tgctaattggcagtagcacgatttatcgtgtgccg

SEQ ID NO: 673 - DNA, 830 bp, synthetic construct
  source 1..830: mol_type = other DNA
ctcggcatatcggctatcatgcaatattattggctgggcatcgactccggtttaaaaactccatcggacttgtatcttgcaatccggctgtcactgccttttccttgcccatcttgaagttcgtcggttcccgttttctccgaacaaggattttgggtagtatgacgacagatgcatcattacttgtgcgagcaaatcggattccattactcatggagcgggcggcgctaatgaatattagccagtacgtcgcgtcgaacgaaggtcaaccatgtcctatcgacactacagtaatagcttcttgcgcacactaagaagtctggacacaagaaccgttgtatcatttggatggttccgctcccagcccggtcagctgtcacaagtgagatcaaacccgacttcgtccgagggaaatggctttcatatcagtgaaaaggtgtcaatataagtgaacatttcaccaatctgcggcacacgataaatcgtgctactgccaattagcagttggcgtagagaagcaatcgagtaactgataggaaaagaaggtattataagggaaaatttagaacgtggttccctcactaaccaacctttagacaaggctcctatcgtgccggggttcttgtgcccattataaggtcgaaggaggagactataggcggcaatggaaccatcatcttcacacatcgagggtgttctggaacaattatgacgtttcaatgaagggcatgcgatacaaaaatgcaatggtgacttcaaggtcaatattgccttcatttacagaaactggtaatctatcttcaattgcagccagagaactccccatctga

SEQ ID NO: 674 - DNA, 2005 bp, synthetic construct
  source 1..2005: mol_type = other DNA
agtgtgctggaattcgcccttgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatc

SEQ ID NO: 675 - DNA, 316 bp, synthetic construct
  source 1..316: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtag

SEQ ID NO: 676 - DNA, 552 bp, synthetic construct
  source 1..552: mol_type = other DNA
cgagcatctctctctagtcatagtttatctttgtataaatgggggcctcaacgcaaggccgcaaaactactcccaacttttataactcatttctgctcccaacacttgatcgaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgcaggtgatacccgcgtgcaactcggcgtacgtcgtttttattcgctgacttcacccgctaattactataacttgaaaacacagagcaataagatcactatgtcctactcccgagtctttgag

SEQ ID NO: 677 - DNA, 19 bp, synthetic construct
  source 1..19: mol_type = other DNA
aactcacgatcctgccttg

SEQ ID NO: 678 - DNA, 17 bp, synthetic construct
  source 1..17: mol_type = other DNA
actgggtacaatgcggc

SEQ ID NO: 679 - DNA, 39 bp, synthetic construct
  source 1..39: mol_type = other DNA
aacaggtctcaacctgctaggttctccaatttcattcgt

SEQ ID NO: 680 - DNA, 37 bp, synthetic construct
  source 1..37: mol_type = other DNA
aacaggtctcaacctactggattaggttgaagaaccg

SEQ ID NO: 681 - DNA, 42 bp, synthetic construct
  source 1..42: mol_type = other DNA
ttcaatctacttgcggacctctgatcaagtgttgggagcaga

SEQ ID NO: 682 - DNA, 35 bp, synthetic construct
  source 1..35: mol_type = other DNA
ctctcgcttgcataccacatgcaggtgatacccgc

SEQ ID NO: 683 - DNA, 38 bp, synthetic construct
  source 1..38: mol_type = other DNA
aacaggtctcatgtttgaattcctggataggttgcatg

SEQ ID NO: 684 - DNA, 31 bp, synthetic construct
  source 1..31: mol_type = other DNA
aacaggtctcatgttgcagagaagcccgctc

SEQ ID NO: 685 - DNA, 42 bp, synthetic construct
  source 1..42: mol_type = other DNA
tctgctcccaacacttgatcagaggtccgcaagtagattgaa

SEQ ID NO: 686 - DNA, 39 bp, synthetic construct
  source 1..39: mol_type = other DNA
gcgggtatcacctgcatctacaagtcgacatcagtgagc

SEQ ID NO: 687 - DNA, 2453 bp, synthetic construct
  source 1..2453: mol_type = other DNA
tagtcgtgtgcattcatacagtaatggcgatttcatctaaccgcacacaatagaaatcggaagcaggtcggttgcaaccaagttccaactgccgctttgactccacctcacctttcccccagccggacagcctgcttttcttcttagttgttcggtgcaacactggaacctggaaagattgtcggcagttctccatcctgagtatctataatttctttctattcggggtgtgttcggttcgagcatggcgcgtattggctaggttctccaatttcattcgtcaggtatgacctgggtatgaccgacctgtttacttctcgtaattgatatttcaacaattcctcttagatatccatctctgagattggtaaggagtatttcgcacgacaggcctaacactagatcacctttcctaccttccatgcacgcttacatctcatgcttgctgtagtaaagaagaggtcgtgtgccacattgctagaacaaagcatgcattacgtcaataccactggattaggttgaagaaccggcgatctgggcagacgcgccacgctctgagtacctaagggtgtacttaaatttatcacagcttgacgtttgacctggaagcttgatttacgcaaggttggaacttgcaccccccggtcgagcatctctctctagtcatagtttatctttgtataaatgggggcctcaacgcaaggccgcaaaactactcccaacttttataactcatttctgctcccaacactcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaa

SEQ ID NO: 688 - DNA, 2180 bp, synthetic construct
  source 1..2180: mol_type = other DNA
tctccactgacgtaagggatgacgcacaatcccactatccttcgcaagaccttcctctatataaggaagttcatttcatttggagaggacacgctgaaatcaccagtctctctctacaaatctatctctctcgagctttcgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgtgcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttctaaaggcttagctgtatgcacaattgttggacgtttgcattaatgtcccgaacgcaaaaaatgcaagacatttgcaagtattgtaattagtagatgtacgaatatccagcatgtatgtttgtaccccaaaatattacggcacccaaaaataaatacagtttgctcggcgctagtcagtgaatgacgcacctaaatagatcatattgttgcaacattacccatgccatgccactgccgtgcccctactctgaccgaacttcgatatccaacgcaccctaataattaaatataccaccgtaaaaaagaagggagaaaagtcttccaagttgctacgtccccactgtttgggggtttccagagcccaaaaatctcaatcggccccagagtggacactggacacgaaccaggaatcctactcggtactgaagaagggattatctattgttagggcgtactgaggccccaaaaatgagtagctctattcggtgaagcaagatatattaactattattagagcacgttggcaacttgacatcattacaggttcatcttcaaggtatgcattatgcctgtttgggtatcgcgtcttgagggactctcaaagtcttgaccaagcgatccaaactgaagcgacgccggacgcgaatgtaatgcaaagactttcttcctttgacccaattgggcttttccctttgtgtctaatcggatactttaaagtcaattatctcgtcatgccactgctcttatctaacatt

SEQ ID NO: 689 - DNA, 4206 bp, synthetic construct
  source 1..4206: mol_type = other DNA
tccttcttcatctaacactcttatttatacctgaagttaacccctgtttttcttcgacaggattggcgatatctcgcgatccatggcccaactcagaatatttgcagctaaatacccaccggaaggcatcaaaaccccaccacccaaactttcatggcagtccacacgtacagcactcgttgggaagcgtcctttagtgcgcatgactccggtagttgaagtaccagatgataccgtcccgcctcttctcactttccgcaatattgatgttctacatcaacgacttatctatgaggacagagtatctgatatagcatatctcacttggttatgcaagtcatacgaatggggtttgcgcattcggcgcgacaaggcacataaatccaaagctgccgatgcctagtgttgacgcctgcctacacgtttgcctttgcagcaccgtcttgtataattttctattttaaattattaatgcatctaacacgatttgtagggtactttatcttatcttttaaatcaattaaatttgctcattgttggccgtagatataggagatttatggaggttttcatcttgctttcacagtctcaccataatagtcgtgtgcattcatacagtaatggcgatttcatctaaccgcacacaatagaaatcggaagcaggtcggttgcaaccaagttccaactgccgctttgactccacctcacctttcccccagccggacagcctgcttttcttcttagttgttcggtgcaacactggaacctggaaagattgtcggcagttctccatcctgagtatctataatttctttctattcggggtgtgttcggttcgagcatggcgcgtattggctaggttctccaatttcattcgtcaggtatgacctgggtatgaccgacctgtttacttctcgtaattgatatttcaacaattcctcttagatatccatctctgagattggtaaggagtatttcgcacgacaggcctaacactagatcacctttcctaccttccatgcacgcttacatctcatgcttgctgtagtaaagaagaggtcgtgtgccacattgctagaacaaagcatgcattacgtcaataccactggattaggttgaagaaccggcgatctgggcagacgcgccacgctctgagtacctaagggtgtacttaaatttatcacagcttgacgtttgacctggaagcttgatttacgcaaggttggaacttgcaccccccggtcgagcatctctctctagtcatagtttatctttgtataaatgggggcctcaacgcaaggccgcaaaactactcccaacttttataactcatttctgctcccaacacttgatcatgcaggtgatacccgcgtgcaactcggcgtacgtcgtttttattcgctgacttcacccgctaattactataacttgaaaacacagagcaataagatcactatgtcctactcccgagtctttgagaaacatgggatggctctctgtcagcgatgcggtctacagcgagttcataggagagttggctacccgcgcttccaatcgaaattactccaacgagttcggcctcatgcaacctatccaggaattcaaggctttcattgaaagcgacccggtggtgcaccaagaatttattgacatgttcgagggcattcaggactctgttagtctttactttatgtatattgtattttcttacttatcatgtgtagccaaggaattatcaggaactatgtaatatgttcaacgatatctttcgcaaagctcccgtctacggagaccttggccctcccgtttatatgattatggccaaattaatgaacacccgagcgggcttctctgcattcacgagacaaaggttgaaccttcacttcaaaaaacttttcgatacctggggattgttcctgtcttcgaaagattctcgaaatgttcttgtggccgaccagttcgacgacagacattgcggctggttgaacgagcgggccttgtctgctatggttaaacattacaatggacgcgcatttgatgaagtcttcctctgcgataaaaatgccccatactacggcttcaactcttacgacgacttctttaatcgcagatttcgaaaccgagatatcgaccgacctgtcgtcggtggagttaacaacaccaccctcatttctgctgcttgcgaatcactttcctacaacgtctcttatgacgtccagtctctcgacactttagttttcaaaggagagacttattcgcttaagcatttgctgaataatgaccctttcaccccacaattcgagcatgggagtattctacaaggattcttgaacgtcaccgcttaccaccgatggcacgcacccgtcaatgggacaatcgtcaaaatcatcaacgttccaggtacctactttgcgcaagccccgagcacgattggcgaccctatcccggataacgattacgacccacctccttaccttaagtctcttgtctacttctctaatattgccgcaaggcaaattatgtttattgaagccgacaacaaggaaattggcctcattttccttgtgttcatcggcatgaccgaaatctcgacatgtgaagccacggtgtccgaaggtcaacacgtcaatcgtggcgatgacttgggaatgttccatttcggtggttcttcgttcgcgcttggtctgaggaaggattgcagggcagagatcgttgaaaagttcaccgaacccggaacagtgatcagaatcaacgaagtcgtcgctgctctaaaggcttagctgtatgcacaattgttggacgtttgcattaatgtcccgaacgcaaaaaatgcaagacatttgcaagtattgtaattagtagatgtacgaatatccagcatgtatgtttgtaccccaaaatattacggcacccaaaaataaatacagtttgctcggcgctagtcagtgaatgacgcacctaaatagatcatattgttgcaacattacccatgccatgccactgccgtgcccctactctgaccgaacttcgatatccaacgcaccctaataattaaatataccaccgtaaaaaagaagggagaaaagtcttccaagttgctacgtccccactgtttgggggtttccagagcccaaaaatctcaatcggccccagagtggacactggacacgaaccaggaatcctactcggtactgaagaagggattatctattgttagggcgtactgaggccccaaaaatgagtagctctattcggtgaagcaagatatattaactattattagagcacgttggcaacttgacatcattacaggttcatcttcaaggtatgcattatgcctgtttgggtatcgcgtcttgagggactctcaaagtcttgaccaagcgatccaaactgaagcgacgccggacgcgaatgtaatgcaaagactttcttcctttgacccaattgggcttttccctttgtgtctaatcggatactttaaagtcaattatctcgtcatgccactgctcttatctaacattagtccttcaccttcaattcaatgacggcctttcctttgagaagatcaaatatacggtgaatacataccttcagcagcgtggcgattcataataagtgtactcaaagggtccttctatttaacaggtattattatgacggcgaatatgaaaacgtaaaacaatgtaaccccctgcatgagatgatatcatatcacgcatgatcctcatgcctgaaaagattgtgtacacgttgtgaacagattagattgtacccgcgatggtcgacttctatactaactgatagatacataaggctagtgtcctgaaggtcaagaccagtagctctcccctcatcctgtcatccaaaatacaccgctatgcatatcagaaatccttaccgtacaccaattgactatcaagcactttcagaggccttccctcccctcaagccattgtgcgtttgccgtctacttcctatttaaaaatgctgatcctccatgatagtgtgtctgtcaatgcagatggtaccagttctgttgacctcactatcccagaagcccagaggtcagcactgtatatctattcaaatgcttaggctgatttaagctagggcgttcacggctgctcttcttcatcgtgacttcgggctcaccatgaccataccagaagaccgtctgtgcccaacagtacgtcaaagatgcct

SEQ ID NO: 690 - DNA, 23 bp, synthetic construct
  source 1..23: mol_type = other DNA
tcgtttctcgtagagtgaggcgg

SEQ ID NO: 691 - DNA, 23 bp, synthetic construct
  source 1..23: mol_type = other DNA
aagggaataggaatgccaggcgg

SEQ ID NO: 692 - DNA, 23 bp, synthetic construct
  source 1..23: mol_type = other DNA
agacaccgatattctctacgtgg

SEQ ID NO: 693 - DNA, 23 bp, synthetic construct
  source 1..23: mol_type = other DNA
tcatatattagaagtcaacgcgg

SEQ ID NO: 694 - DNA, 1319 bp, synthetic construct
  source 1..1319: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgaaaggaggattcacaggaggagatgaatatcaaaaacatttcctcccaagagattatctcgcaacatattattctttcgatggatctccatctccagaagcagaaatgctcaaattcaacctcgaatgcctccataaaacattcggaccaggaggactccaaggagatacactcatcgatatcggatctggaccaacaatctatcaagtcctcgcagcattcgattctttccaagatatcacactctctgatttcacagatagaaacagagaagaactcgaaaaatggctcaaaaaagaaccaggagcatatgattggacaccagcagtcaaattcgcatgcgaactcgaaggaaactctggaagatgggaagaaaaagaagaaaaactcagagcagcagtcaaaagagtcctcaaatgcgatgtccatctcggaaacccactcgcaccagcagtcctcccactcgcagattgcgtcctcacactcctcgcaatggaatgcgcatgctgctctctcgatgcatatagagcagcactctgcaacctcgcatctctcctcaaaccaggaggacatctcgtcacaacagtcacactcagactcccatcttatatggtcggaaaaagagaattctcttgcgtcgcactcgaaaaagaagaagtcgaacaagcagtcctcgatgcaggattcgatatcgaacaactcctccattctccacaatcttattctgtcacaaacgcagcaaacaacggagtctgcttcatcgtcgcaagaaaaaaaccaggaccaagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatc

SEQ ID NO: 695 - DNA, 1322 bp, synthetic construct
  source 1..1322: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgaagggcggcttcaccggcggcgacgagtaccagaagcacttcctcccccgcgactacctcgccacctactactcgttcgacggctcgccctcgcccgaggccgagatgctcaagttcaacctcgagtgcctccacaagaccttcggccccggcggcctccagggcgacaccctcatcgacatcggctcgggccccaccatctaccaggtcctcgccgccttcgactcgttccaggacatcaccctctcggacttcaccgaccgcaaccgcgaggagctcgagaagtggctcaagaaggagcccggcgcctacgactggacccccgccgtcaagttcgcctgcgagctcgagggcaactcgggccgctgggaggagaaggaggagaagctccgcgccgccgtcaagcgcgtcctcaagtgcgacgtccacctcggcaaccccctcgcccccgccgtcctccccctcgccgactgcgtcctcaccctcctcgccatggagtgcgcctgctgctcgctcgacgcctaccgcgccgccctctgcaacctcgcctcgctcctcaagcccggcggccacctcgtcaccaccgtcaccctccgcctcccctcgtacatggtcggcaagcgcgagttctcgtgcgtcgccctcgagaaggaggaggtcgagcaggccgtcctcgacgccggcttcgacatcgagcagctcctccactcgccccagtcgtactcggtcaccaacgccgccaacaacggcgtctgcttcatcgtcgcccgcaagaagcccggcccctagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatc

SEQ ID NO: 696 - DNA, 1319 bp, synthetic construct
  source 1..1319: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgagtgaatgcacaaacttcacagaaggagaattctatcaggcacattttgacccgcgtgcttatgtcaggaatttctactccagccctcgaggacactccgacgaaaaggatttccttacttttgttttaggggtcttcagtagattattttcaactgggaaacacagagggcaaaggttgatagacgtggggagcggaccatcaatccactgcgtcattagcgcctgcgcacactatgacgagattcttctgtctgatttctctgacaacaatcgtagagaaattgaaaaatggctaaaaaaccaagaagggtgtctagattggagtcccatcctccagcacgttagtaaaacggaggggaaaagaccgtccgatttagaggctacgctgaagcaaagaatcaaaaaggttttaaaatgtgacgtccgcctggagaatccgtttgatccgctgacactggaaccagctgactgtgtcattacatctctgtgcttggaagcagcctgtaaagacatgcagatataccgccaggctttacatgggttgaccaagctcctgtgtcccggtggactattcgtcatggtgggtgttctgagtgaaaccttctacaaggtggatgaacagctcttttcttgtcttagcctcaaacagaatgatatcgaggaagcactgaaaggttttggcttctctatccaagagtttaatgtactacctgctgaagaccaaaacaattctgtgtctgactttgaggccgtttttgttcttgtggcgaccaagaacatctgaagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatc

SEQ ID NO: 697 - DNA, 1292 bp, synthetic construct
  source 1..1292: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgtatcagtccatgtttgatccaaaaacatatttagcttctttttgcagttttggaaaaggaagagatagaatattgaatttccgcctacagaaatgttttgaaacatttggaccaggtggtgttggaggagacactttgattgacataggcagtggtccttcaatctaccaactggcttcagcttgtgaatctttcagaaatataattgccacagattttactgactgtaatcgtcaagaatttcaaaaatggctaaataatgagccaggatcatttgattggtcagagcttctgcaggctgtttgtaacctagaaggcaacagagaaaactggagagaaaaggaagacaagttgcgagcaacaatcaaaaaggttctgaaatgtgatgtgacaaaaagcaatccactacacccagagattctgcctaaagctgattgtttgatcagtgctctgtgcttggaagtagcctgtaaagacattgatgcttataaagatgcagtgagaaacataaccacgctgttaaaaccaggaggccatctggtagctattggtgtatttggggatagtttttacaaggttggcaaacagacatttttctgcttgccattggatgaggagacagttagaaatactgtaataaatgctggttataccattaaagagctggaggtatttcctattgatgatgcttcgttatatggtgaccttacagattgctgtgctaatttttttctcgttgctaagaaaaatctcacataaagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatc

SEQ ID NO: 698 - DNA, 1415 bp, synthetic construct
  source 1..1415: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgcaggtgatacccgcgtgcaactcggcgtacgtcgtttttattcgctgacttcacccgctaattactataacttgaaaacacagagcaataagaaagggcggcttcaccggcggcgacgagtaccagaagcacttcctcccccgcgactacctcgccacctactactcgttcgacggctcgccctcgcccgaggccgagatgctcaagttcaacctcgagtgcctccacaagaccttcggccccggcggcctccagggcgacaccctcatcgacatcggctcgggccccaccatctaccaggtcctcgccgccttcgactcgttccaggacatcaccctctcggacttcaccgaccgcaaccgcgaggagctcgagaagtggctcaagaaggagcccggcgcctacgactggacccccgccgtcaagttcgcctgcgagctcgagggcaactcgggccgctgggaggagaaggaggagaagctccgcgccgccgtcaagcgcgtcctcaagtgcgacgtccacctcggcaaccccctcgcccccgccgtcctccccctcgccgactgcgtcctcaccctcctcgccatggagtgcgcctgctgctcgctcgacgcctaccgcgccgccctctgcaacctcgcctcgctcctcaagcccggcggccacctcgtcaccaccgtcaccctccgcctcccctcgtacatggtcggcaagcgcgagttctcgtgcgtcgccctcgagaaggaggaggtcgagcaggccgtcctcgacgccggcttcgacatcgagcagctcctccactcgccccagtcgtactcggtcaccaacgccgccaacaacggcgtctgcttcatcgtcgcccgcaagaagcccggcccctagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatc

SEQ ID NO: 699 - DNA, 1322 bp, synthetic construct
  source 1..1322: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtttctcccaccatgaagggcggcttcaccggcggcgacgagtaccagaagcacttcctcccccgcgactacctcgccacctactactcgttcgacggctcgccctcgcccgaggccgagatgctcaagttcaacctcgagtgcctccacaagaccttcggccccggcggcctccagggcgacaccctcatcgacatcggctcgggccccaccatctaccaggtcctcgccgccttcgactcgttccaggacatcaccctctcggacttcaccgaccgcaaccgcgaggagctcgagaagtggctcaagaaggagcccggcgcctacgactggacccccgccgtcaagttcgcctgcgagctcgagggcaactcgggccgctgggaggagaaggaggagaagctccgcgccgccgtcaagcgcgtcctcaagtgcgacgtccacctcggcaaccccctcgcccccgccgtcctccccctcgccgactgcgtcctcaccctcctcgccatggagtgcgcctgctgctcgctcgacgcctaccgcgccgccctctgcaacctcgcctcgctcctcaagcccggcggccacctcgtcaccaccgtcaccctccgcctcccctcgtacatggtcggcaagcgcgagttctcgtgcgtcgccctcgagaaggaggaggtcgagcaggccgtcctcgacgccggcttcgacatcgagcagctcctccactcgccccagtcgtactcggtcaccaacgccgccaacaacggcgtctgcttcatcgtcgcccgcaagaagcccggcccctagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatc

SEQ ID NO: 700 - DNA, 1322 bp, synthetic construct
  source 1..1322: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgaagggcggcttcaccggcggcgacgagtaccagaagcacttcctcccccgcgactacctcgccacctactactcgttcgccggctcgccctcgcccgccgccgagatgctcaagttcaacctcgagtgcctccacaagaccttcggccccggcggcctccagggcgacaccctcatcgacatcggctcgggccccaccatctaccaggtcctcgccgccttcgactcgttccaggacatcaccctctcggacttcaccgaccgcaaccgcgaggagctcgagaagtggctcaagaaggagcccggcgcctacgactggacccccgccgtcaagttcgcctgcgagctcgagggcaactcgggccgctgggaggagaaggaggagaagctccgcgccgccgtcaagcgcgtcctcaagtgcgacgtccacctcggcaaccccctcgcccccgccgtcctccccctcgccgactgcgtcctcaccctcctcgccatggagtgcgcctgctgctcgctcgacgcctaccgcgccgccctctgcaacctcgcctcgctcctcaagcccggcggccacctcgtcaccaccgtcaccctccgcctcccctcgtacatggtcggcaagcgcgagttctcgtgcgtcgccctcgagaaggaggaggtcgagcaggccgtcctcgacgccggcttcgacatcgagcagctcctccactcgccccagtcgtactcggtcaccaacgccgccaacaacggcgtctgcttcatcgtcgcccgcaagaagcccggcccctagagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatc

SEQ ID NO: 701 - DNA, 1607 bp, synthetic construct
  source 1..1607: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgccaagaatccaagtcctcgatatcagaggatctaaagaatctgtcggatctacaccacatctcagagcagcaatcctcgaaggactcctcaaaccaccaggatctagaacactcccatctgaaacactctatgatgaagtcggactcaaaatgtataacgatggaatgaaagcatgggcagaatggtattatccagtcgaagcagaaagacaaatcctcgaaagatatggaagagatatcgcaaaactcttcacaacatctgcaaaaggaaaagcagtcctcatcgaactcggagcaggatctctcgataaaacatctcaagtcctcctctctgcagcagaaatcacaagaacaacaggaccaatgaacaacatcgcatattatgcactcgatctcgaaagaggagaactcgaaagaacaatcggaagactccaagaagtcatcggagatcaaatcgcaggaaaaatctctacagcaggaatgtggggaacatatgatgatggaatcagagtcatcgaaaaaaacgaactcgaactcgaaccagatatcccagtccatatcctcttcctcggaggaacaatcggaaacttctctaaacaagatggagatgtcgcattcctcaaatctctcccactcgatcataaaagaggagatacactcctcgtcggaatggatagacataaatctgcagatgcaatcgaaagatcttatggattcgcagcagcaaaagattggatcatgaacggactcaaagtctctggaagagtcctcacaggagatgaaggactcttcgaaatcggaaactgggaaagatatgcaaaatataacgaagaactcggaagatatgaagcaggatataaatctcaaaaagaacatgcactcaaaatctctgaaggagtcgatatcacattcctcaaagatgaagtcgtcctcgtcatgttctctaacaaatatacagatgcagaaatggattctgtcgtcgattctgcaggactcgtcaaaaacggatcttggatggatgaaaaagcacaatattgcctcctctctctcagagcaaacaacggaccagtctgaagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatc

SEQ ID NO: 702 - DNA, 1607 bp, synthetic construct
  source 1..1607: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgccgcgaatccaggttcttgacatccgaggctcgaaggagtcagtgggttcaacaccccatctccgggctgcgatccttgaaggtctactgaagccgccagggagtagaacactcccttctgaaacgctctacgatgaggtcggcttgaagatgtacaacgatgggatgaaagcttgggcagagtggtactaccccgtggaagcagaaagacagatcctggagagatacggaagagatatcgcgaagctgttcactacatcggccaaaggcaaagcagtactgattgagcttggagctggctcgttggataagacgtcgcaggtcttgttgtctgctgctgagattaccaggacgacagggccgatgaataacattgcgtactacgcactggatctcgaacgcggtgagctggaacgcacgattggaaggctccaggaagtcataggtgatcaaattgccggtaagatctcgacggcaggtatgtggggaacctacgatgatggcattcgcgtgatcgagaaaaacgaactggaactggaacccgacatcccagtacatatcttgttcctgggaggaacaattgggaattttagcaagcaagatggagacgtggctttcttgaagagcttacctttggaccacaagcgcggagacacgctgctagttggaatggatagacacaaatcggcagatgccatagaacgctcttacggttttgctgctgcaaaggactggattatgaacggtttgaaggtgtcaggaagggtgcttactggggacgaggggttatttgaaattggcaattgggagagatatgccaaatacaacgaagaattaggtcgatatgaggcaggatataaatcacagaaagaacacgccctcaagatctccgagggtgttgatataacgttcttaaaagacgaggtcgttttagtcatgttctctaacaagtacaccgatgctgagatggatagtgtggtcgacagtgctggactggtaaaaaatgggtcttggatggacgagaaggctcaatactgcttactctcattgagagcaaacaatgggccggtctaaagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatc

SEQ ID NO: 703 - DNA, 1475 bp, synthetic construct
  source 1..1475: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatgagacaaatcgaaatcgaatgggtccaaccaggaatcacagtcacagcagatctctcttgggaaagaaacccagaactcgcagaactcctctggacaggactcctcccatataactctctccaaaaccatgcactcgtctctggaaaccatctctatcatctcatcgcagatccaagactcgtctatacagaagcaagatataaagaagatagaacaaaatctccagatggaacagtcttcctctctcaactccaacatctcgcagtcaaatatggaccactcacagaatatctcccagcagcaccagtcggatctgtcgtcccagaagatatcgatgcactcagagaagcaggaagagcatgctggaaagcagcatgggaaacaaaacaaccaatcgaagtcagagtcagaagaaaaggagaagcagtcacagatttcgcactcccaagaacaccaccagtcgatcatccaggagtccaaaaactcgtcgaagaaatccaagatgaaacagaaagagtctggatcacaccaccagcagaaatcgtcgatatgcatcaaggaagaatcgcatctagagcaggatcttatgatcaatatttctctacactcgtcttcctcaacggagaagtcagaccactcggatattgcgcactcaacggactcctcaaaatctgcagaacaacagatctcacactcaacgatctcaaaagaatcacaccaacattcatcaaaacaccagcagaattcctcggatatacaggactcgatacactctggagattcacacaacaagtcctcacactcctcccagatgtcgaaacaagagaacaatatttcgcactcgtcaacgcactcgcactctatgcaaacatgctcaacacatggaacctccatttcttcccatggcaacatggaacagattatagatatctcgatgcatgaagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatc

SEQ ID NO: 704 - DNA, 1589 bp, synthetic construct
  source 1..1589: mol_type = other DNA
gaggtccgcaagtagattgaaagttcagtacgtttttaacaatagagcattttcgaggcttgcgtcattctgtgtcaggctagcagtttataagcgttgaggatctagagctgctgttcccgcgtctcgaatgttctcggtgtttaggggttagcaatctgatatgataataatttgtgatgacatcgatagtacaaaaaccccaattccggtcacatccaccatctccgttttctcccatctacacacaacaagctcatcgccgtttgtctctcgcttgcataccacccagcagctcactgatgtcgacttgtagatggcaaacttctctgaatctaaatctatgatggcagtcttcttcatgttcttcctcctcctcctctcttcttcttcttcttcttcttcttcttctccaatcctcaaaaaaatcttcatcgaatctccatcttatgcaccaaacgcattcacattcgattctacagataaaggattctatacatctgtccaagatggaagagtcatcaaatatgaaggaccaaactctggattcacagatttcgcatatgcatctccattctggaacaaagcattctgcgaaaactctacagatccagaaaaaagaccactctgcggaagaacatatgatatctcttatgattataaaaactctcaaatgtatatcgtcgatggacattatcatctctgcgtcgtcggaaaagaaggaggatatgcaacacaactcgcaacatctgtccaaggagtcccattcaaatggctctatgcagtcacagtcgatcaaagaacaggaatcgtctatttcacagatgtctcttctatccatgatgattctccagaaggagtcgaagaaatcatgaacacatctgatagaacaggaagactcatgaaatatgatccatctacaaaagaaacaacactcctcctcaaagaactccatgtcccaggaggagcagaaatctctgcagatggatctttcgtcgtcgtcgcagaattcctctctaacagaatcgtcaaatattggctcgaaggaccaaaaaaaggatctgcagaattcctcgtcacaatcccaaacccaggaaacatcaaaagaaactctgatggacatttctgggtctcttcttctgaagaactcgatggaggacaacatggaagagtcgtctctagaggaatcaaattcgatggattcggaaacatcctccaagtcatcccactcccaccaccatatgaaggagaacatttcgaacaaatccaagaacatgatggactcctctatatcggatctctcttccattcttctgtcggaatcctcgtctatgatgatcatgataacaaaggaaactcttatgtctcttcttgaagtagatgccgaccggatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatc

SEQ ID NO: 705 - protein, 263 aa, synthetic construct
MKGGFTGGDEYQKHFLPRDYLATYYSFDGSPSPEAEMLKFNLECLHKTFGPGGLQGDTLIDIGSGPTIYQVLAAFDSFQDITLSDFTDRNREELEKWLKKEPGAYDWTPAVKFACELEGNSGRWEEKEEKLRAAVKRVLKCDVHLGNPLAPAVLPLADCVLTLLAMECACCSLDAYRAALCNLASLLKPGGHLVTTVTLRLPSYMVGKREFSCVALEKEEVEQAVLDAGFDIEQLLHSPQSYSVTNAANNGVCFIVARKKPGP

SEQ ID NO: 706 - protein, 262 aa, synthetic construct
MSECTNFTEGEFYQAHFDPRAYVRNFYSSPRGHSDEKDFLTFVLGVFSRLFSTGKHRGQRLIDVGSGPSIHCVISACAHYDEILLSDFSDNNRREIEKWLKNQEGCLDWSPILQHVSKTEGKRPSDLEATLKQRIKKVLKCDVRLENPFDPLTLEPADCVITSLCLEAACKDMQIYRQALHGLTKLLCPGGLFVMVGVLSETFYKVDEQLFSCLSLKQNDIEEALKGFGFSIQEFNVLPAEDQNNSVSDFEAVFVLVATKNI

SEQ ID NO: 707 - protein, 253 aa, synthetic construct
MYQSMFDPKTYLASFCSFGKGRDRILNFRLQKCFETFGPGGVGGDTLIDIGSGPSIYQLASACESFRNIIATDFTDCNRQEFQKWLNNEPGSFDWSELLQAVCNLEGNRENWREKEDKLRATIKKVLKCDVTKSNPLHPEILPKADCLISALCLEVACKDIDAYKDAVRNITTLLKPGGHLVAIGVFGDSFYKVGKQTFFCLPLDEETVRNTVINAGYTIKELEVFPIDDASLYGDLTDCCANFFLVAKKNLT

SEQ ID NO: 708 - protein, 275 aa, synthetic construct
MQVIPACNSAAIRKGGFTGGDEYQKHFLPRDYLATYYSFDGSPSPEAEMLKFNLECLHKTFGPGGLQGDTLIDIGSGPTIYQVLAAFDSFQDITLSDFTDRNREELEKWLKKEPGAYDWTPAVKFACELEGNSGRWEEKEEKLRAAVKRVLKCDVHLGNPLAPAVLPLADCVLTLLAMECACCSLDAYRAALCNLASLLKPGGHLVTTVTLRLPSYMVGKREFSCVALEKEEVEQAVLDAGFDIEQLLHSPQSYSVTNAANNGVCFIVARKKPGP

SEQ ID NO: 709 - protein, 358 aa, synthetic construct
MPRIQVLDIRGSKESVGSTPHLRAAILEGLLKPPGSRTLPSETLYDEVGLKMYNDGMKAWAEWYYPVEAERQILERYGRDIAKLFTTSAKGKAVLIELGAGSLDKTSQVLLSAAEITRTTGPMNNIAYYALDLERGELERTIGRLQEVIGDQIAGKISTAGMWGTYDDGIRVIEKNELELEPDIPVHILFLGGTIGNFSKQDGDVAFLKSLPLDHKRGDTLLVGMDRHKSADAIERSYGFAAAKDWIMNGLKVSGRVLTGDEGLFEIGNWERYAKYNEELGRYEAGYKSQKEHALKISEGVDITFLKDEVVLVMFSNKYTDAEMDSVVDSAGLVKNGSWMDEKAQYCLLSLRANNGPV

SEQ ID NO: 710 - protein, 262 aa, synthetic construct
KGGFTGGDEYQKHFLPRDYLATYYSFAGSPSPAAEMLKFNLECLHKTFGPGGLQGDTLIDIGSGPTIYQVLAAFDSFQDITLSDFTDRNREELEKWLKKEPGAYDWTPAVKFACELEGNSGRWEEKEEKLRAAVKRVLKCDVHLGNPLAPAVLPLADCVLTLLAMECACCSLDAYRAALCNLASLLKPGGHLVTTVTLRLPSYMVGKREFSCVALEKEEVEQAVLDAGFDIEQLLHSPQSYSVTNAANNGVCFIVARKKPGP

SEQ ID NO: 711 - protein, 314 aa, synthetic construct
MRQIEIEWVQPGITVTADLSWERNPELAELLWTGLLPYNSLQNHALVSGNHLYHLIADPRLVYTEARYKEDRTKSPDGTVFLSQLQHLAVKYGPLTEYLPAAPVGSVVPEDIDALREAGRACWKAAWETKQPIEVRVRRKGEAVTDFALPRTPPVDHPGVQKLVEEIQDETERVWITPPAEIVDMHQGRIASRAGSYDQYFSTLVFLNGEVRPLGYCALNGLLKICRTTDLTLNDLKRITPTFIKTPAEFLGYTGLDTLWRFTQQVLTLLPDVETREQYFALVNALALYANMLNTWNLHFFPWQHGTDYRYLDA

SEQ ID NO: 712 - protein, 352 aa, synthetic construct
MANFSESKSMMAVFFMFFLLLLSSSSSSSSSSPILKKIFIESPSYAPNAFTFDSTDKGFYTSVQDGRVIKYEGPNSGFTDFAYASPFWNKAFCENSTDPEKRPLCGRTYDISYDYKNSQMYIVDGHYHLCVVGKEGGYATQLATSVQGVPFKWLYAVTVDQRTGIVYFTDVSSIHDDSPEGVEEIMNTSDRTGRLMKYDPSTKETTLLLKELHVPGGAEISADGSFVVVAEFLSNRIVKYWLEGPKKGSAEFLVTIPNPGNIKRNSDGHFWVSSSEELDGGQHGRVVSRGIKFDGFGNILQVIPLPPPYEGEHFEQIQEHDGLLYIGSLFHSSVGILVYDDHDNKGNSYVSS

SEQ ID NO: 713 - DNA, 500 bp, unidentified
  source 1..500: mol_type = unassigned DNA
attggctaggttctccaatttcattcgtcaggtatgacctgggtatgaccgacctgttcaattctcgtaattgatatttcaacaattcctcttagatatccatctctgagattggtaaggagtatcacgacaggcctaacactagatcacctttcctaccttccatgcacgcttacatctcatgcttgctgtagtaaagaagaggtcgtgtgccacattgctcgaacaaagcatgcattacgtcaataccactggattaggttgaagaaccggcgatctgggcagacgcgccacgctctgagtacctaagggtgtacttaaatttatcacagcttgacgtttgacctggaagcttgatttacgcaaggttggaacttgcaccccccggtcgagcatctctctctagtcatagtttatctttgtataaatgggggcctcaacgcaaggccgcaaaactactcccaacttttataactcatttctgctcccaacacttgatc

SEQ ID NO: 714 - DNA, 500 bp, unidentified
  source 1..500: mol_type = unassigned DNA
aagcgatccaaactgaagcgacgccggacgcgaatgtaatgcaaagactttcttcctttgacccaattgggcttttccctttgtgtctaatcggatactttaaagtcaattatctcatcatgccactgctcttatctaacattagtccttcaccttcaattcaatgacggcctttcctttgagaagatcgaatatacggtgaatacataccttcagcagcgtggcgattcataataagtgtactcaaagggtccttctatttaacaggtattattatgacggcgaatatgaaaacgtaaaacaatgtaaccccctgcatgagatgatatcatatcacgcatgatcctcatgcctgaaaagattgtgtacacgttgcgaacagattagattgtaccccacgatggtcgacttctatactaactgatagatacataaggctagtgtcctgaaggtcaagaccagtagctctcccctcatcctgtcatccaaaatacaccgct

SEQ ID NO: 715 - DNA, 500 bp, unidentified
  source 1..500: mol_type = unassigned DNA
gcgcaagaagctattactgtagtgtcgataggacatggttgaccttcgttcgacgcgacgtactggctaatattcattagcgccgcccgctccatgagtaatggaatccgatttgctcgcacaagtaatgatgcatctgtcgtcatactacccaaaatccttgttcggagaaaacgggaaccgacgaacttcaagatgggcaaggaaaaggcagtgacagccggatcgcaagatacaagtccgatggagtttttaaaccggagtcgatgcccagccaataatattgcatgatagccgatatgccgagtgatgccatcaccaattttgtccttttcgggttagatctataggggcaaacagggacaattcaaaagacccacccacgccgaaaatggcccagagcttcttaatgacaactaattaaagatttgcatttagccagcgagactctgacgaaattcggagctcttttcccctctcttgaaccatccccttaccct

SEQ ID NO: 716 - DNA, 500 bp, unidentified
  source 1..500: mol_type = unassigned DNA
cgccaaagtcactgcaggtattgctgctcatattgtgatgtggaccgactttatgcagtgggggagcgaggaagaaaggataaattttgtgaaaaagggggtagctgcctttcacgacgccaggggcaacaacgacaatggggaaattacgtctaccttactgaaggaatcatccactgcgtaatgtagctgttcatacatgtataatgcaaattttgtagaagtgctcgtgctcgtctattactagtactacctgactctaaagtggggagatcagagggtggacgagagcatttccatctggatagttaaaagaacacccatacgtcagctcgaccgaacaagatcatttctagatctaattttggaacgaagagtggggcttaaaagggacaaagaagataatgttcggctttgcacaatgcctattcgcctcgaggttcgtcacgtttattggttaaaagaatccgtcgctgaggctcactgggcatctccccatc

SEQ ID NO: 717 - DNA, 500 bp, unidentified
  source 1..500: mol_type = unassigned DNA
ttagtggacaaaacatcatgctaaaatggatctcacactgattggttttggcacccttctcttgcgtaatgcatcgcctgacacagggattgtagtacgcgacctggcagttccaaattttggttagtcttgaaccttgccatgatttgccttagctaccttccgggaagttatctggccgtagcttctccgcagcgtgccttaaaggcttccaattaaaggaatattccatcatcctgagtatctaaaactcgaagataaggaaatgctaaatggttgacttagtttaacagtgtagtatacttgatttatgtacggtatgttttttgctcggcgatgtaatcgcacggcgttacgtgctacgtcgatgttgatgagctgcttttgcgcatcgttccaaaaatagacttaatcttaagtacttagcccagcgagttcaaattgaaaagtgagcgactctcctcggttcccccttcttaagagctttaacttctcttact

SEQ ID NO: 718 - DNA, 500 bp, unidentified
  source 1..500: mol_type = unassigned DNA
gcacaccaagccgagtaatgaggtaggctatttgaagagatttgaaggcccataaagagttgggggtaattttacacagtattaagcaagcatgaaagcagtgccatcagaaaaaggttgttgtttgctgataacgtaatcgttacctgtcatcacacttcgttgaattttagcgagaccacatttttcttttaacaacgacggtcaacattgacattagaaaaccataaattgttcctcatttcactttcaagcttttctgagatcaaatagttcattcaatcacagcttttcatgcattgaaggtttttgagcacaatcgacgtttcaatggggtcgctgcgcgtatacatgtggtcacttttgatgcgcattctaatggtcagcaagttttccatatgttatgaaaaagaataagcgaggtataggtatgttgatgcctcttatataacgtacgctcacttagtaaagttgtcatcgctttccgacagtgctcttta

SEQ ID NO: 719 - DNA, 500 bp, unidentified
  source 1..500: mol_type = unassigned DNA
tatgtaccctttatgtttctgctcggcgaggagaacaaaggcagacacaatagaccggcatttcgggccgatgtttgttccagatattgcagccggaacaatgccgtggtggcgtgggaactcgtgatctgttgatagtctgaccgccaggtcacagggtttctgatcacgacagtcgtgactttcacgcccccattcccccccaatatcccccctgcccctgcctccagagcgtcccctccggatctctcttctaggtccccattctgaaggtgaatcctcatagctgaccccagtgcgagcacgttccaactttccgcttttttctagcccaaatatcaaccaagcaagacccggggcatcctccatatctccccccaacggcgccaaagtccagtcttcaggcctaaagcctcccaatagtcgacaccctatctgacaacgggcccataacccccagataaactcttttatcaagaaagtcaacccatctgcgctcc

SEQ ID NO: 720 - DNA, 500 bp, unidentified
  source 1..500: mol_type = unassigned DNA
cgtttcggcgctgcaatgtcacctaatgatctaacgactacgtttctttgctcattgtgatttggcacttaataatgctccaaccgtgctatcgaatcatgacaggcaaatcaatacagatggattcttttggtattcaagcacaggcagaatcaaacatggttattagacttcaataatctgaagtcgtgtgatatgagcatggttctggacgttctttattggctcagaataccggcactaaagccgctcaatctataattaacgagtctaaaccatgaaagttgtttagcttgtcgctataattaatggaagtgacattcactatgcttacgatgcacatcatcttagatctattcttctgcacgtaacatacagcagccaggcgaccgatgccctcccccgccgggctggagaagcactgcaggatgcaaatacttaaatacggggtaggatgtacatcgagaggttaacgctcagtcccagggccttcgttcaat

SEQ ID NO: 721 - DNA, 500 bp, unidentified
  source 1..500: mol_type = unassigned DNA
taaaggtcaagaggttattttggacacctgagagtcaaggaaggtagattatgcctgcaatacatgtttacatttaaaaactagaagaaagtaagattgcgattgggtgtaaaaaagcttgatgtaatactggaatagcctgaatacttgttaaagggtgagcagcaaggcgttgtgtataactaaagttcaagtcatgagtaaaggagctcagaatcgcattatacttacctagtcagacaaaagttgtaggtgaactgtaattgcgatcaagaactgaagcaaattaaagaacaagggggaaaagaaggtacactcataccaactcaagtcaaagtaccgatacatcgttgctattcataccaatgttccgctgaagccatgaagaagatcggtcattaaatgtgccgttgtgcctagaccccaattctcgttaaactgcctggtagtatactcgtataaaagacttgcttcaaagatgttcctttgcaagtttcaag

SEQ ID NO: 722 - protein, 298 aa, unidentified
MHIRNPYRDSINYQALAEAYPDLKPYVKVNPVDDTIYTAALIQRDFGLVISLPPDRLCPTVPNRLNYVLWVQDILKVTSDALGLREDRPIKGIDIGTGASAIYPFLGCVLSKNWSMVATEVEQKCIDVARLNVVANNLQDRITILATSIDGPILVPLLEATADYEYEFTMCNPPFYDGAADMQTSDAAKGFGFGVNAPHTGSVIEMSTEGGEAAFVAQMVRESLDLRTRCRWFTSNLGKLASLHGIVGLLREYKITNYAINEYIQGTTRRYAIAWSFTDVRLPDELFRPSNPDLAALF

SEQ ID NO: 723 - protein, 309 aa, unidentified
MHIRNPYRDGVDYQALAEAFPALKPHVTVNSDNTTSIDFAVPEAQRLYTAALLHRDFGLTITLPEDRLCPTVPNRLNYVLWVEDILKVTSDALGLPDNRQVKGIDIGTGASAIYPMLACSRFKTWSMVATEVDQKCIDTARLNVIANNLQERLAIIATSVDGPILVPLLQANSDFEYDFTMCNPPFYDGASDMQTSDAAKGFGFGVNAPHTGTVLEMATEGGESAFVAQMVRESLNLQTRCRWFTSNLGKLKSLYEIVGLLREHQISNYAINEYVQGATRRYAIAWSFIDVRLPDHLSRPSNPDLSSLF

SEQ ID NO: 724 - protein, 309 aa, unidentified
MHIRNPYRTPIDYQALSEAFPPLKPFVSVNADGTSSVDLTIPEAQRAFTAALLHRDFGLTMTIPEDRLCPTVPNRLNYVLWIEDIFNYTNKTLGLSDDRPIKGVDIGTGASAIYPMLACARFKAWSMVGTEVERKCIDTARLNVVANNLQDRLSILETSIDGPILVPIFEATEEYEYEFTMCNPPFYDGAADMQTSDAAKGFGFGVGAPHSGTVLEMSTEGGESAFVAQMVRESLKLRTRCRWYTSNLGKLKSLKEIVGLLKELEISNYAINEYVQGSTRRYAVAWSFTDIQLPEELSRPSNPELSSLF

SEQ ID NO: 725 - protein, 312 aa, unidentified
MHIRNPYRTPIDYQALVEAFPPLKPYVTVNQDNTTSIDLTVPEVQRLYTAALLHRDFGLVIDLPEDRLCPTLLTRTPSLNYVLWVEDILKVTNTALGLSEDRPVKGIDIGTGAAAIYPMLACARFKTWSMIGTEIDRKCIDTARVNVITNNLQDRLSIIETSIDGPILVPIFEATTDYEYDFTMCNPPFYDGAADMQTSDAAKGFGFGVNAPHSGTVIEMSTEGGESAFVAQMVRESLDHRTRCRWFTSNLGKLKSLHEIVGLLREHQISNYAINEYVQGTTRRYAIAWSFTNIRLPEDLTRPSNPELSSLF

SEQ ID NO: 726 - protein, 496 aa, unidentified
MQNGALTVFVAFISAACIYYVHARRARRASLPPGPRGIPLPFVGNVFDMPSESSWLTFLEWGKQYQSDLIYLNSGGIEMVILNTLETMTDLLEKRGSIYSGRLESTMVNELMGWKFDFGFVTYGERWREERRMFSREFNEKNIKQFRHAQVKALKELVRKLDKDPSRWYQHLRHQIASMALDIGYGIDLAENDPWIEETILANDALALASVPGCYWVDSFPILQYVPSWLPFAGFKRKAKVWKKNTEYMVNVLYETMKRQTVQGLTRPSYASARLQAMAPDINLEHQERVIKNSASQVIVGGGDTTVSALAAFILAMVKYPNVQRKVQAELDAIASQNEIPDFDEENGTMPYLTACLKEVFRWNQIAPLGIAHRLDKDDSYRGYLIPKGTLVFANIWAILNDPLMYPNPGEFQPERYLGPDGKHDPSVRDPRKIAFGWGRRACPGIYLAQSTVWHTATNLLSAFNIEPPLNEEGKPIKVEAAFTTGFFRYSPRSDA

SEQ ID NO: 727 - protein, 503 aa, unidentified
MHTDSIVISLAAGLAVCIHFANSRRLRRASLPPGPPGIPLPFVGNMFDMPSESPWLKYLQWGKEYQSDIIYLNAGGTEIIVLNTLEAITDLLEKRGSIYSGRLESTMVNELMGWDFDLGFITYGERWREERRMFAKEFNEKNIKQFRHAQIKAANQLVQQLAKTPQRWYQHIRHRIAAMSLDIGYGIDLPEDDPWIAATMLANEGLAEASVPGSFWVDSFPILKYIPSWMPGAGFKRKAKIWRENGDHMVDMPYETMKKLHAEGLARPSYAWARLQAMDPNGDLEHQEHVIRNTSTEVNVGGGDTTVSAVSAFILAMVKYPKVQRKIQEELDSVLNRGEIPDFDEENDPLPYLTACVKEVFRWNQIAPLAIAHRLDKDDVYRGYLIPKGALVFANSWAVLNDPQVYPNPSEFRPERYLDSEGRPDNTVRDPRKAAFGYGRRNCPGIHLAQTTVWIVAATLLSVFNIERPVDANGTPIDIPAAFTTGFFRYDRFTRLCHLSDFS

SEQ ID NO: 728 - protein, 485 aa, unidentified
MITIVLSLLIAGCVYYTNARRIKRSSLPPGPPGIPIPFIGNMFDMPSESPWLTFLQWGQEYQTDIIYVDAGGSDMIILNSLEAITNLLEKRGSLYSGRLESTMVNELMGWEFDFGFIPYGERWREERRMFAKEFTEKNIRQFRHAQVKAANQLVRQLTDKPDRWSHHIRHQIASMALDIGYGIDLAEDDPWIAASELANEGLAVASVPGSFWVDTFPFLKYIPSWLPGAEFKRNAKVWKEGADHMVNMPYERMKKLSAQGLTRPSYASARLQAMDPNGDLEHQERVIKNTATQVNVGGGDTTVGAVSAFILAMVKYPEVQRKVQAELDEFTSKGRIPDYDEDNDSLPYLSACFKELFRWGQIAPLAIAHRLIKDDVYREYTIPKNALVFANNWTVLNDPSEYPNPSEFRPERYLGPDGKPDDTVRDPRKAAFGYGRRVCPGIHLAQSTVWIAGVALVSAFNIELPVDKDGKPIDIPAAFTTGFFR

SEQ ID NO: 729 - protein, 485 aa, unidentified
MIAVLFSFVIAGCIYYIVSRRVRRSRLPPGPPGIPIPFIGNMFDMPSESPWLTFLQWGRDYNTDILYVDAGGTEMVILNTLEAITDLLEKRGSIYSGRLESTMVNELMGWEFDLGFITYGDRWREERRMFAKEFSEKGIKQFRHAQVKAAHQLVQQLTKTPDRWAQHIRHQIAAMSLDIGYGIDLAEDDPWLEATHLANEGLAIASVPGKFWVDSFPSLKYLPAWFPGAVFKRKAKVWREAADHMVDMPYETMRKLAPQGLTRPSYASARLQAMDLNGDLEHQEHVIKNTAAEVNVGGGDTTVSAMSAFILAMVKYPEVQRKVQAELDALTNNGQIPDYDEEDDSLPYLTACIKELFRWNQIAPLAIPHRLMKDDVYRGYLIPKNTLVFANTWAVLNDPEVYPNPSVFRPERYLGPDGKPDDTVRDPRKAAFGYGRRNCPGIHLAQSTVWIAGATLLSAFNIERPVDQNGKPIDIPADFTTGFFR

SEQ ID NO: 730 - protein, 491 aa, unidentified
MAPLTTMITIVLSLLLAGCIYYINARRVRRSHLPPGPPGIPIPFIGNMFDMPSESPWLTFLQWGRDYQTDILYVDAGGSEMIILNSLEAITDLLEKRGSIYSGRLESTMVNELMGWEFDLGFITYGERWREERRMFAKEFSEKNIRQFRHAQVQAANRLVRQLIKTPGRWSQHIRHQIAAMSLDIGYGIDLAEDDPWLEATQLANEGLAIASVPGSFWVDSFPSLKYLPSWLPGAGFKRKAKVWKEGADHMVDMPYETMKKLSAQGLARPSYASARLQAMDPNGDLEHQEHVIKNTATEVNVGGGDTTVSAMSAFILAMVKYPEVQRKAQAELDMLTSKGLIPDYDEEDDSLPYLTACVKELFRWNQIAPLAIAHKLIKDDVYRGYLIPKNALVFANTWAVLNDPEEYPDPSEFRPERYLGPDGKPDHTVRDPRKAAFGYGRRTCPGLHLAQSTVWIAGATLLSVFNVERPVDRTGKPIDIPAAFTTGFFR

SEQ ID NO: 731 - protein, 485 aa, unidentified
MITILLSLLLAGCIYYINARRVRRSHLPPGPPGIPIPFIGNMFDMPSESPWLTFLQWGRDYQTDILYVDAGGSEMIILNSLEAITDLLEKRGSIYSGRLESTMVNELMGWEFDLGFITYGERWREERRMFAKEFSEKNIRQFRHAQVQAANRLVRQLIKTPGRWSQHIRHQIAAMSLDIGYGIDLAEDDPWLEATQLANEGLAIASVPGSFWVDSFPSLKYLPSWLPGAGFKRNARVWKEGADHMVNMPYETMKKLSAQGLARPSYASARLQAMDPNGDLEHQEHVIKNTATEVNVGGGDTTVSAMSAFILAMVKYPEVQRKVQAELDVLTSKGLIPDYDEEDDSLPYLTACVKELFRWNQIAPLAIAHRLIKDDVYRGYTIPKNALVFANTWAVLNDPEEYPNPSEFRPERYLGPDGKPDHTVRDPRKAAFGYGRRTCPGLHLAQSTVWIAGATLLSVFNIERPVDRTGKPIDIPAAFTTGFFR

SEQ ID NO: 732 - DNA, 420 bp, synthetic construct
  source 1..420: mol_type = other DNA
ggtaccagcagtaccagcaccagccactgcattattgaatctgacatctgcaacagcaaagtacaatttttgttttacattttactcattaatattagcacctatagctgtggccaatcttttgacgacgactctctcacgctggaggaaagcatggtacgggcattaattgccagcgtagaacaagcgtaggatatgggcaacctcgctgatttctatatttggtaagaagtctcaccccgtgagctaagcaaaaagcaaaacccttgctatgtcaacatcccactgccatacactattgtccccttcggggtgacatacgaaaaaattggaacgatacagagaagattagcatggcccctgcacaaggatgacacgctttcccggagtggtagatctacggatctcaatatttatttt

SEQ ID NO: 733 - DNA, 420 bp, synthetic construct
  source 1..420: mol_type = other DNA
cgatttctttagggccgtaggctagtaatcatcgaccgttttaatcattaatgtacttagacaataaatataagatgcaatacaagtcaatgggagaaactagactttacaaaacctttaaaagccctggtgagatatgagaaggtttatgacagaatatatcgccattaatgtgaggttgtggacactgctggtagtcaaggctgcccgtgaaccatatttagtcacatgtaatcaccccgcgtgctaaacaaaaagcaaaatatcagtaagatagtcacagtcataacactgttgtttgtccccttcggggtgacatacgaaaaaattggaacgatacagagaagattagcatggcccctgcacaaggatgacacgctttcccggagtggtagatctacggatctcaatatttatttt

SEQ ID NO: 734 - DNA, 420 bp, synthetic construct
  source 1..420: mol_type = other DNA
tgccaaaaagccttcttgtggcctgcttactattaaggcaactaattcaagaacaagtgattctgggtaggtagatgccacagttcatgataataaaggcgaagtcagaaggagtagtccgttgatgaagaaagcagaaggcaaggaatgttggtggcttttggttgcggtagcactgaaaccgtgtccggacctcgccgggagcagacaatggcttggttggattacataataataccccgcgggccagacaatattcaaaatcctaacaaagatgtctcaggtaatacattcgctaatgtccccttcggggtgacatacgaaaaaattggaacgatacagagaagattagcatggcccctgcacaaggatgacacgctttcccggagtggtagatctacggatctcaatatttatttt

SEQ ID NO: 735 - protein, 439 aa, unidentified
MQVIPACNSAAIRSLCPTPESFRNMGWLSVSDAVYSEFIGELATRASNRNYSNEFGLMQPIQEFKAFIESDPVVHQEFIDMFEGIQDSPRNYQELCNMFNDIFRKAPVYGDLGPPVYMIMAKLMNTRAGFSAFTRQRLNLHFKKLFDTWGLFLSSKDSRNVLVADQFDDRHCGWLNERALSAMVKHYNGRAFDEVFLCDKNAPYYGFNSYDDFFNRRFRNRDIDRPVVGGVNNTTLISAACESLSYNVSYDVQSLDTLVFKGETYSLKHLLNNDPFTPQFEHGSILQGFLNVTAYHRWHAPVNGTIVKIINVPGTYFAQAPSTIGDPIPDNDYDPPPYLKSLVYFSNIAARQIMFIEADNKEIGLIFLVFIGMTEISTCEATVSEGQHVNRGDDLGMFHFGGSSFALGLRKDCRAEIVEKFTEPGTVIRINEVVAALKA

SEQ ID NO: 736 - protein, 439 aa, unidentified
MQVLPACQSSALKTLCPSPEAFRKLGWLPTSDEVYNEFIDDLTGRTCNEKYSSQVTLLKPIQDFKTFIENDPIVYQEFISMFEGIEQSPTNYHELCNMFNDIFRKAPLYGDLGPPVYMIMARIMNTQAGFSAFTKESLNFHFKKLFDTWGLFLSSKNSRNVLVADQFDDKHYGWFSERAKTAMMINYPGRTFEKVFICDEHVPYHGFTSYDDFFNRRFRDKDTDRPVVGGVTDTTLIGAACESLSYNVSHNVQSLDTLVIKGEAYSLKHLLHNDPFTPQFEHGSIIQGFLNVTAYHRWHSPVNGTIVKIVNVPGTYFAQAPYTIGSPIPDNDRDPPPYLKSLVYFSNIAARQIMFIEADNKDIGLIFLVFIGMTEISTCEATVCEGQHVNRGDDLGMFHFGGSSFALGLRKDSKAKILEKFAKPGTVIRINELVASVRK

SEQ ID NO: 737 - protein, 485 aa, unidentified
MIAVLFSFVIAGCIYYIVSRRVRRSRLPPGPPGIPIPFIGNMFDMPEESPWLTFLQWGRDYNTDILYVDAGGTEMVILNTLETITDLLEKRGSIYSGRLESTMVNELMGWEFDLGFITYGDRWREERRMFAKEFSEKGIKQFRHAQVKAAHQLVQQLTKTPDRWAQHIRHQIAAMSLDIGYGIDLAEDDPWLEATHLANEGLAIASVPGKFWVDSFPSLKYLPAWFPGAVFKRKAKVWREAADHMVDMPYETMRKLAPQGLTRPSYASARLQAMDLNGDLEHQEHVIKNTAAEVNVGGGDTTVSAMSAFILAMVKYPEVQRKVQAELDALTNNGQIPDYDEEDDSLPYLTACIKELFRWNQIAPLAIPHKLMKDDVYRGYLIPKNTLVFANTWAVLNDPEVYPDPSVFRPERYLGPDGKPDNTVRDPRKAAFGYGRRNCPGIHLAQSTVWIAGATLLSAFNIERPVDQNGKPIDIPADFTTGFFR

SEQ ID NO: 738 - DNA, 23 bp, synthetic construct
  source 1..23: mol_type = other DNA
gaaccatccaaatgatacaacgg

SEQ ID NO: 739 - DNA, 23 bp, synthetic construct
  source 1..23: mol_type = other DNA
gaaccgacgaacttcaagatggg

SEQ ID NO: 740 - DNA, 23 bp, synthetic construct
  source 1..23: mol_type = other DNA
cagtacgtcgcgtcgaacgaagg

SEQ ID NO: 741 - DNA, 23 bp, synthetic construct
  source 1..23: mol_type = other DNA
gtctaaaggttggttagtgaggg

SEQ ID NO: 742 - DNA, 4102 bp, synthetic construct
  source 1..4102: mol_type = other DNA
gataaaaaatattcaatcggattggatatcggaacaaactcagtcggatgggcagtcatcacagatgaatataaagtcccatcaaaaaaattcaaagtcttgggaaacacagatagacattcaatcaaaaaaaacttgatcggagcattgttgttcgattcaggagaaacagcagaagcaacaagattgaaaagaacagcaagaagaagatatacaagaagaaaaaacagaatctgctatttgcaagaaatcttctcaaacgaaatggcaaaagtcgatgattcattcttccatagattggaagaatcattcttggtcgaagaagataaaaaacatgaaagacatccaatcttcggaaacatcgtcgatgaagtcgcatatcatgaaaaatatccaacaatctatcatttgagaaaaaaattggtcgattcaacagataaagcagatttgagattgatctatttggcattggcacatatgatcaaattcagaggacatttcttgatcgaaggagatttgaacccagataactcagatgtcgataaattgttcatccaattggtccaaacatataaccaattgttcgaagaaaacccaatcaacgcatcaggagtcgatgcaaaagcaatcttgtcagcaagattgtcaaaatcaagaagattggaaaacttgatcgcacaattgccaggagaaaaaaaaaacggattgttcggaaacttgatcgcattgtcattgggattgacaccaaacttcaaatcaaacttcgatttggcagaagatgcaaaattgcaattgtcaaaagatacatatgatgatgatttggataacttgttggcacaaatcggagatcaatatgcagatttgttcttggcagcaaaaaacttgtcagatgcaatcttgttgtcagatatcttgagagtcaacacagaaatcacaaaagcaccattgtcagcatcaatgatcaaaagatatgatgaacatcatcaagatttgacattgttgaaagcattggtcagacaacaattgccagaaaaatataaagaaatcttcttcgatcaatcaaaaaacggatatgcaggatatatcgatggaggagcatcacaagaagaattctataaattcatcaaaccaatcttggaaaaaatggatggaacagaagaattgttggtcaaattgaacagagaagatttgttgagaaaacaaagaacattcgataacggatcaatcccacatcaaatccatttgggagaattgcatgcaatcttgagaagacaagaagatttctatccattcttgaaagataacagagaaaaaatcgaaaaaatcttgacattcagaatcccatattatgtcggaccattggcaagaggaaactcaagattcgcatggatgacaagaaaatcagaagaaacaatcacaccatggaacttcgaagaagtcgtcgataaaggagcatcagcacaatcattcatcgaaagaatgacaaacttcgataaaaacttgccaaacgaaaaagtcttgccaaaacattcattgttgtatgaatatttcacagtctataacgaattgacaaaagtcaaatatgtcacagaaggaatgagaaaaccagcattcttgtcaggagaacaaaaaaaagcaatcgtcgatttgttgttcaaaacaaacagaaaagtcacagtcaaacaattgaaagaagattatttcaaaaaaatcgaatgcttcgattcagtcgaaatctcaggagtcgaagatagattcaacgcatcattgggaacatatcatgatttgttgaaaatcatcaaagataaagatttcttggataacgaagaaaacgaagatatcttggaagatatcgtcttgacattgacattgttcgaagatagagaaatgatcgaagaaagattgaaaacatatgcacatttgttcgatgataaagtcatgaaacaattgaaaagaagaagatatacaggatggggaagattgtcaagaaaattgatcaacggaatcagagataaacaatcaggaaaaacaatcttggatttcttgaaatcagatggattcgcaaacagaaacttcatgcaattgatccatgatgattcattgacattcaaagaagatatccaaaaagcacaagtctcaggacaaggagattcattgcatgaacatatcgcaaacttggcaggatcaccagcaatcaaaaaaggaatcttgcaaacagtcaaagtcgtcgatgaattggtcaaagtcatgggaagacataaaccagaaaacatcgtcatcgaaatggcaagagaaaaccaaacaacacaaaaaggacaaaaaaactcaagagaaagaatgaaaagaatcgaagaaggaatcaaagaattgggatcacaaatcttgaaagaacatccagtcgaaaacacacaattgcaaaacgaaaaattgtatttgtattatttgcaaaacggaagagatatgtatgtcgatcaagaattggatatcaacagattgtcagattatgatgtcgatcatatcgtcccacaatcattcttgaaagatgattcaatcgataacaaagtcttgacaagatcagataaaaacagaggaaaatcagataacgtcccatcagaagaagtcgtcaaaaaaatgaaaaactattggagacaattgttgaacgcaaaattgatcacacaaagaaaattcgataacttgacaaaagcagaaagaggaggattgtcagaattggataaagcaggattcatcaaaagacaattggtcgaaacaagacaaatcacaaaacatgtcgcacaaatcttggattcaagaatgaacacaaaatatgatgaaaacgataaattgatcagagaagtcaaagtcatcacattgaaatcaaaattggtttcagatttcagaaaagatttccaattctataaagtcagagaaatcaacaactatcatcatgcacatgatgcatatttgaacgcagtcgtcggaacagcattgatcaaaaaatatccaaaattggaatcagaattcgtctatggagattataaagtctatgatgtcagaaaaatgatcgcaaaatcagaacaagaaatcggaaaagcaacagcaaaatatttcttctattcaaacatcatgaacttcttcaaaacagaaatcacattggcaaacggagaaatcagaaaaagaccattgatcgaaacaaacggagaaacaggagaaatcgtctgggataaaggaagagatttcgcaacagtcagaaaagtcttgtcaatgccacaagtcaacatcgtcaaaaaaacagaagtccaaacaggaggattctcaaaagaatcaatcttgccaaaaagaaactcagataaattgatcgcaagaaaaaaagattgggatccaaaaaaatatggaggattcgattcaccaacagtcgcatattcagtcttggtcgtcgcaaaagtcgaaaaaggaaaatcaaaaaaattgaaatcagtcaaagaattgttgggaatcacaatcatggaaagatcatcattcgaaaaaaacccaatcgatttcttggaagcaaaaggatataaagaagtcaaaaaagatttgatcatcaaattgccaaaatattcattgttcgaattggaaaacggaagaaaaagaatgttggcatcagcaggagaattgcaaaaaggaaacgaattggcattgccatcaaaatatgtcaacttcttgtatttggcatcacattatgaaaaattgaaaggatcaccagaagataacgaacaaaaacaattgttcgtcgaacaacataaacattatttggatgaaatcatcgaacaaatctcagaattctcaaaaagagtcatcttggcagatgcaaacttggataaagtcttgtcagcatataacaaacatagagataaaccaatcagagaacaagcagaaaacatcatccatttgttcacattgacaaacttgggagcaccagcagcattcaaatatttcgatacaacaatcgatagaaaaagatatacatcaacaaaagaagtcttggatgcaacattgatccatcaatcaatcacaggattgtatgaaacaagaatcgatttgtcacaattgggaggagatc

What is claimed is:

1. An engineered Basidiomycota fungal cell, comprising:
a genetic modification that reduces a level of expression of a PsiM gene, wherein the PsiM gene comprises SEQ ID NO: 4 or a polynucleotide sequence having greater than 75% identity thereto,
wherein the genetic modification reduces the level of expression of the PsiM gene in the engineered Basidiomycota fungal cell relative to an otherwise comparable non-genetically modified Basidiomycota fungal cell.

2. The engineered Basidiomycota fungal cell of claim 1, that is an engineered *psilocybe* fungal cell.

3. The engineered Basidiomycota fungal cell of claim 1, wherein the PsiM gene comprises a double-strand break introduced by a CRISPR system that targets the PsiM gene.

4. The engineered Basidiomycota fungal cell of claim 1, wherein the PsiM gene encodes for an amino acid sequence that is at least 90% identical to SEQ ID NO: 27.

5. The engineered Basidiomycota fungal cell of claim 1, wherein the genetic modification that reduces the level of expression of the PsiM gene comprises a frameshift mutation in the PsiM gene.

6. An engineered fungus comprising:
a population of the engineered Basidiomycota fungal cells of claim 1, wherein the engineered fungus comprises an increased amount of at least one of: norbaeocystin, psilocin, psilocybin, baeocystin, or norpsilocin as measured by percent dry weight compared to a population of otherwise comparable non-genetically modified Basidiomycota fungal cells.

7. A composition comprising the engineered fungus of claim 6; and an excipient.

8. The composition comprising the engineered fungus of claim 7, wherein the composition is in the form of an aerosol, a powder, a gel, a semi-gel, a liquid or a solid.

9. A composition comprising the engineered Basidiomycota fungal cell of claim 1; and an excipient.

10. The composition comprising the engineered Basidiomycota fungal cell and the excipient of claim 9, wherein the composition is in the form of an aerosol, a powder, a gel, a semi-gel, a liquid or a solid.

11. A pharmaceutical composition comprising the engineered Basidiomycota fungal cell of claim 9; and a pharmaceutically acceptable excipient.

12. The pharmaceutical composition of claim 11, that is formulated such that an effective amount of the pharmaceutical composition for treating a health condition can be delivered in a single dose format.

13. The pharmaceutical composition of claim 12, wherein the pharmaceutical composition is formulated as a dosage form for topical, oral, inhalation, or intestinal delivery.

14. A nutraceutical composition comprising the engineered Basidiomycota fungal cell of claim 1; and a phytochemical.

15. A food supplement comprising the engineered Basidiomycota fungal cell of claim 1; and a food.

* * * * *